(12) United States Patent
Eilertsen et al.

(10) Patent No.: US 10,429,378 B2
(45) Date of Patent: Oct. 1, 2019

(54) METHODS OF DIFFERENTIATING PREADIPOCYTES AND USES THEREOF

(71) Applicant: Board Of Supervisors Of Louisiana State University And Agricultural And Mechanical College, Baton Rouge, LA (US)

(72) Inventors: Kenneth James Eilertsen, Baton Rouge, LA (US); Jong Rim, Baton Rouge, LA (US)

(73) Assignee: Board Of Supervisors Of Louisiana State University, Baton Rouge, LA (US)

(*) Notice: Subject to any disclaimer, the term of this patent is extended or adjusted under 35 U.S.C. 154(b) by 40 days.

(21) Appl. No.: 15/267,082

(22) Filed: Sep. 15, 2016

(65) Prior Publication Data

US 2017/0073639 A1    Mar. 16, 2017

Related U.S. Application Data

(60) Provisional application No. 62/218,719, filed on Sep. 15, 2015, provisional application No. 62/294,646, filed on Feb. 12, 2016.

(51) Int. Cl.
*A61K 35/39* (2015.01)
*G01N 33/50* (2006.01)
*C12N 5/0793* (2010.01)

(52) U.S. Cl.
CPC ....... *G01N 33/5044* (2013.01); *C12N 5/0619* (2013.01); *C12N 2501/603* (2013.01); *C12N 2501/604* (2013.01); *C12N 2506/1384* (2013.01); *C12N 2510/00* (2013.01); *G01N 2500/10* (2013.01)

(58) Field of Classification Search
CPC .................................................. G01N 33/5044
See application file for complete search history.

(56) References Cited

PUBLICATIONS

Prusty et al (JBC, 277(48): 46226-46232, 2002 (Year: 2002).*
Zhu et al, (Journal of Science, 122: 2760-2768, 2009) (Year: 2009) (Year: 2009).*
Zebisch et al (Analytical Biochemistry, 425: 88-90, 2012). (Year: 2012).*
Mitchell et al (Stem Cells, 32: 2178-2187, 2014 (Year: 2014).*
Heyworth C, Pearson S, May G, et al. Transcription factor-mediated lineage switching reveals plasticity in primary committed progenitor cells. The EMBO journal 2002;21(14):3770-3781.
Xie H, Ye M, Feng R, et al. Stepwise reprogramming of B cells into macrophages. Cell 2004;117(5):663-676.
Kajimura S, Seale P, Kubota K, et al. Initiation of myoblast to brown fat switch by a PRDM16-C/EBP-beta transcriptional complex. Nature 2009;460(7259):1154-1158.

Huang P, He Z, Ji S, et al. Induction of functional hepatocyte-like cells from mouse fibroblasts by defined factors. Nature 2011;475(7356):386-389.
Buganim Y, Itskovich E, Hu YC, et al. Direct reprogramming of fibroblasts into embryonic Sertoli-like cells by defined factors. Cell stem cell 2012;11(3):373-386.
Vierbuchen T, Ostermeier A, Pang ZP, et al. Direct conversion of fibroblasts to functional neurons by defined factors. Nature 2010;463(7284):1035-1041.
Kim J, Su SC, Wang H, et al. Functional integration of dopaminergic neurons directly converted from mouse fibroblasts. Cell stem cell 2011;9(5):413-419.
Son EY, Ichida JK, Wainger BJ, et al. Conversion of mouse and human fibroblasts into functional spinal motor neurons. Cell stem cell 2011;9(3):205-218.
Yang Z, Ming GL, Song H: Postnatal neurogenesis in the human forebrain: from two migratory streams to dribbles. Cell stem cell 2011;9(5):385-386.
Takahashi K, Yamanaka S: Induction of pluripotent stem cells from mouse embryonic and adult fibroblast cultures by defined factors. Cell 2006;126(4):663-676.
Kim JB, Sebastiano V, Wu G, et al. Oct4—induced pluripotency in adult neural stem cells. Cell 2009;136(3):411-419.
Kim EB, Fang X, Fushan AA, et al. Genome sequencing reveals insights into physiology and longevity of the naked mole rat. Nature 2011;479(7372):223-227.
Shi Y, Do JT, Desponts C, et al. A combined chemical and genetic approach for the generation of induced pluripotent stem cells. Cell stem cell 2008;2(6):525-528.
Tsai SY, Clavel C, Kim S, et al. Oct4 and klf4 reprogram dermal papilla cells into induced pluripotent stem cells. Stem Cells 2010;28(2):221-228.
Liu X, Sun H, Qi J, et al. Sequential introduction of reprogramming factors reveals a time-sensitive requirement for individual factors and a sequential EMT-MET mechanism for optimal reprogramming. Nature cell biology 2013;15(7):829-838.
Szabo E, Rampalli S, Risueno RM, et al. Direct conversion of human fibroblasts to multilineage blood progenitors. Nature 2010;468(7323):521-526.
Zimmerlin L, Donnenberg VS, Rubin JP, et al. Mesenchymal markers on human adipose stem/progenitor cells. Cytometry Part A : the journal of the International Society for Analytical Cytology 2013;83(1):134-140.
Shi Y, Desponts C, Do JT, et al. Induction of pluripotent stem cells from mouse embryonic fibroblasts by Oct4 and Klf4 with small-molecule compounds. Cell stem cell 2008;3(5):568-574.
Huangfu D, Maehr R, Guo W, et al. Induction of pluripotent stem cells by defined factors is greatly improved by small-molecule compounds. Nature biotechnology 2008;26(7):795-797.

(Continued)

*Primary Examiner* — Anoop K Singh
*Assistant Examiner* — Magdalene K Sgagias
(74) *Attorney, Agent, or Firm* — Baker Donelson

(57) ABSTRACT

Described herein are methods of transdifferentiating preadipocytes, populations of transdifferentiated preadipocytes, and methods of using the transdifferentiated preadipocytes.

16 Claims, 25 Drawing Sheets
Specification includes a Sequence Listing.

(56) References Cited

PUBLICATIONS

Mikkelsen TS, Hanna J, Zhang X, et al. Dissecting direct reprogramming through integrative genomic analysis. Nature 2008;454(7200):49-55.

Kim J, Efe JA, Zhu S, et al. Direct reprogramming of mouse fibroblasts to neural progenitors. Proceedings of the National Academy of Sciences of the United States of America 2011;108(19):7838-7843.

Yang L, Li S, Hatch H, et al. In vitro trans-differentiation of adult hepatic stem cells into pancreatic endocrine hormone-producing cells. Proceedings of the National Academy of Sciences of the United States of America 2002;99(12):8078-8083.

Gradwohl G, Dierich A, LeMeur M, et al. neurogenin3 is required for the development of the four endocrine cell lineages of the pancreas. Proceedings of the National Academy of Sciences of the United States of America 2000;97(4):1607-1611.

Meivar-Levy I, Sapir T, Gefen-Halevi S, et al. Pancreatic and duodenal homeobox gene 1 induces hepatic dedifferentiation by suppressing the expression of CCAAT/enhancer-binding protein beta. Hepatology 2007;46(3):898-905.

Kataoka K, Han SI, Shioda S, et al. MafA is a glucose-regulated and pancreatic beta-cell-specific transcriptional activator for the insulin gene. The Journal of biological chemistry 2002;277(51):49903-49910.

Bramswig NC, Everett LJ, Schug J, et al. Epigenomic plasticity enables human pancreatic alpha to beta cell reprogramming. The Journal of clinical investigation 2013;123(3):1275-1284.

McConnell BB, Yang VW: Mammalian Kruppel-like factors in health and diseases. Physiological reviews 2010;90(4):1337-1381.

Thorel F, Nepote V, Avril I, et al. Conversion of adult pancreatic alpha-cells to beta-cells after extreme beta-cell loss. Nature 2010;464(7292):1149-1154.

Jacobsen JP, Weikop P, Hansen HH, et al. SK3 K+ channel-deficient mice have enhanced dopamine and serotonin release and altered emotional behaviors. Genes, brain, and behavior 2008;7(8):836-848.

\* cited by examiner

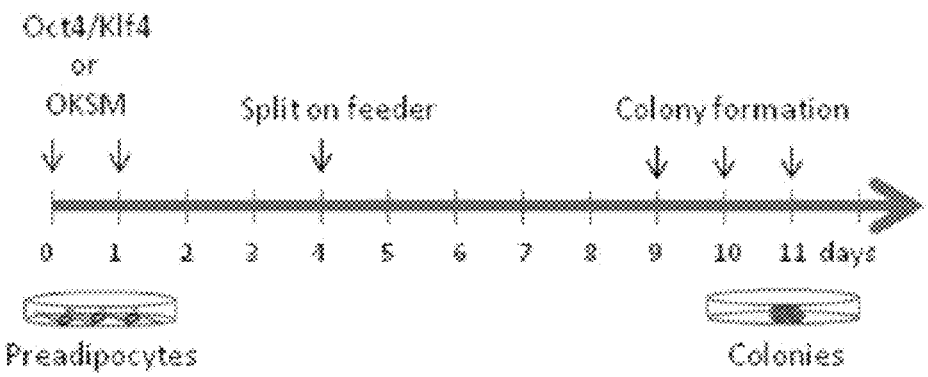
FIG. 1
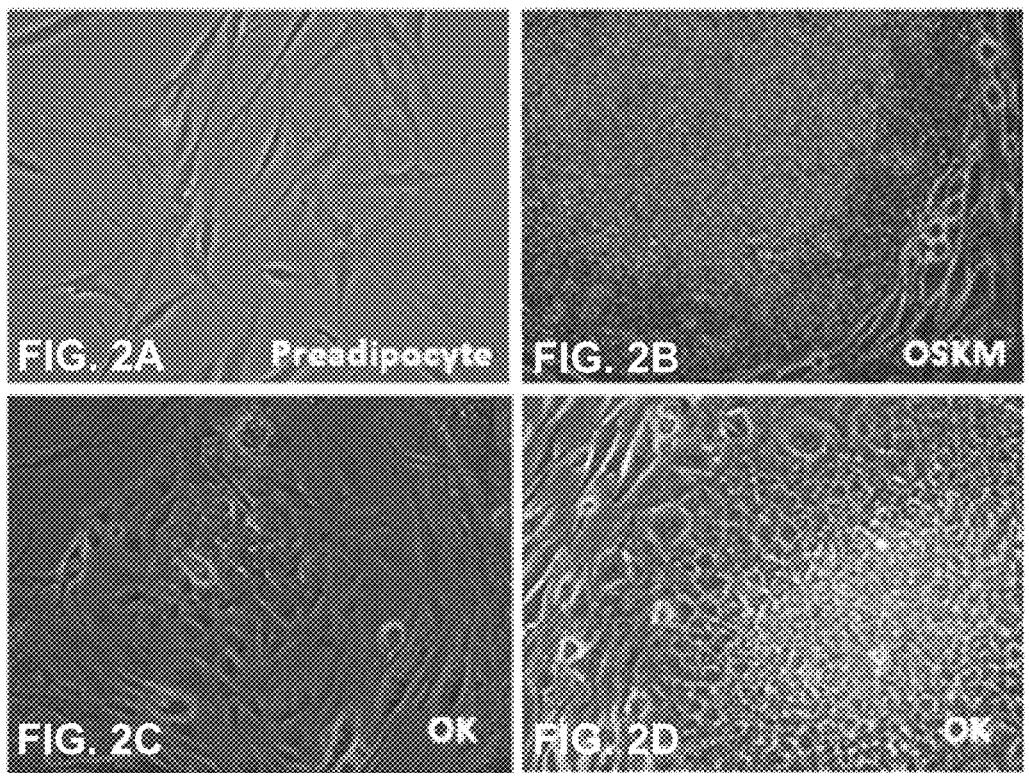

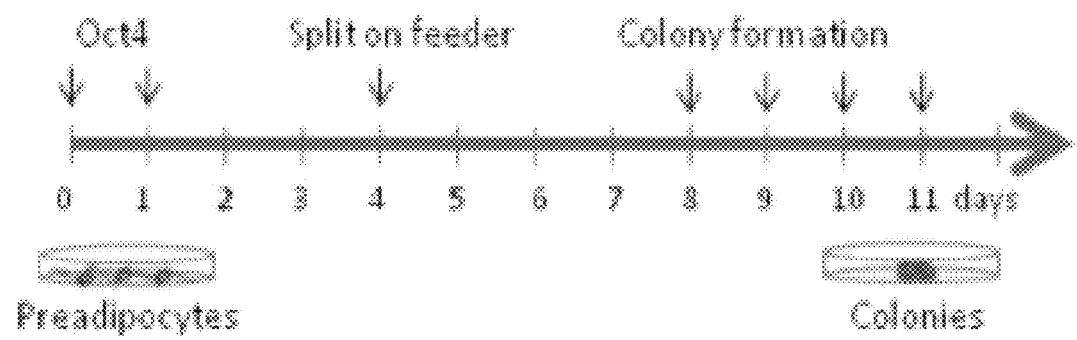
FIG. 12
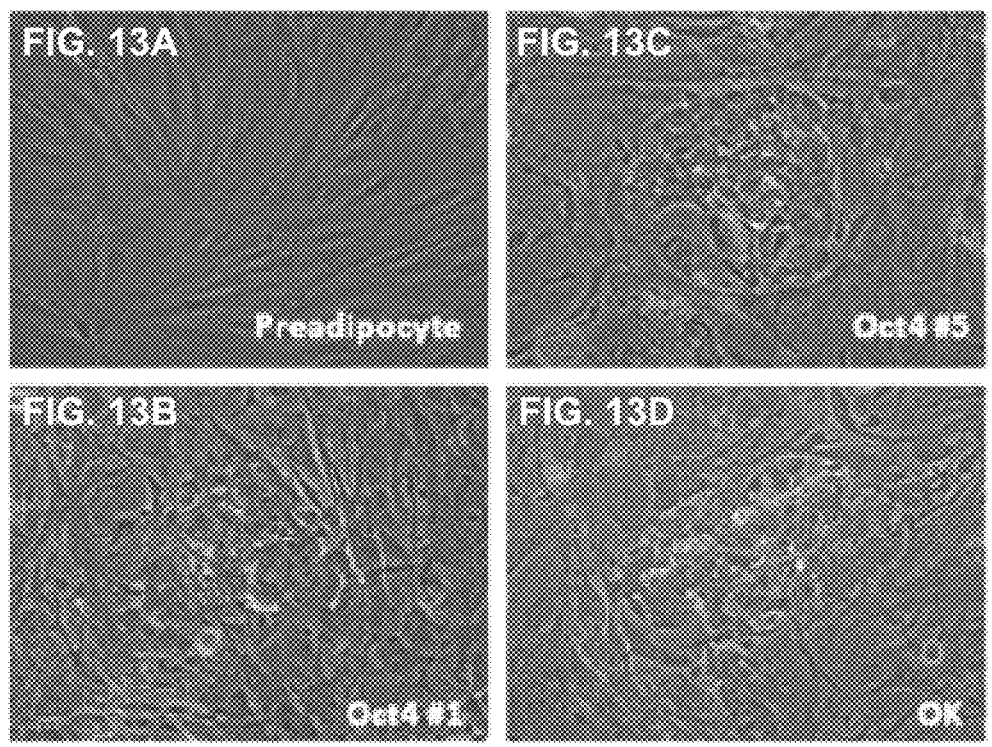

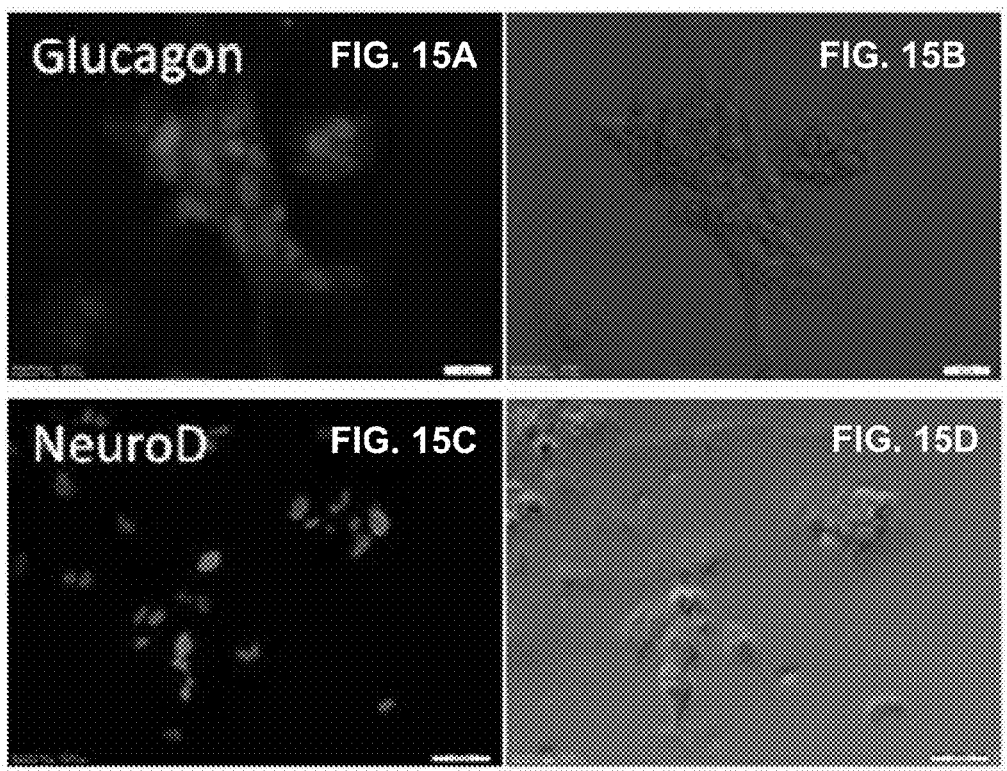

Adipogenic

Chondrogenic

Osteogenic

S 10,429,378 B2

METHODS OF DIFFERENTIATING PREADIPOCYTES AND USES THEREOF

CROSS-REFERENCE TO RELATED APPLICATIONS

This application claims the benefit of and priority to U.S. Provisional Patent Application No. 62/218,719, filed on Sep. 15, 2015, entitled "DIRECT CONVERSION OF HUMAN PREADIPOCYTES INTO HEMATOPOIETIC, NEURONAL AND PANCREATIC ALPHACELLS BY OCT4 AND KLF4 OVEREXPRESSION," the contents of which is incorporated by reference herein in its entirety.

This application also claims the benefit of and priority to U.S. Provisional Patent Application No. 62/294,646, filed on Feb. 12, 2016, entitled "METHODS OF DIFFERENTIATING PREADIPOCYTES AND USES THEREOF," the contents of which is incorporated by reference herein in its entirety

SEQUENCE LISTING

This application contains a sequence listing filed in electronic form as an ASCII.txt file entitled 2222251010_ST25.bd, created on Sep. 15, 2015. The content of the sequence listing is incorporated herein in its entirety.

BRIEF DESCRIPTION OF THE DRAWINGS

Further aspects of the present disclosure will be readily appreciated upon review of the detailed description of its various embodiments, described below, when taken in conjunction with the accompanying drawings.

FIG. 1 shows one embodiment of a method of transdifferentiating preadipocytes.

FIGS. 2A-2D show micrograph images of colony formation during transdifferentiation and reprogramming of human preadipocytes by lentiviral overexpression.

FIG. 12 shows one embodiment of a method to transdifferentiation and reprogramming of human preadipoctyes to pancreatic alpha cells by Oct4 lentiviral overexpression.

FIGS. 13A-13D show micrograph images of colony formation during transdifferentiation and reprogramming of human preadipocytes by lentiviral overexpression.

FIGS. 15A-15D show micrograph images demonstrating immunocytochemistry of transdifferentiated pancreatic alpha cells expressing ectopic Oct4. The Oct4 induced pancreatic alpha cells were seeded on matrigel plates and subjected to immunocytochemistry using glucagon (FIGS. 15A-15B) and NeuroD (FIGS. 15C-15D) specific antibodies and DAPI nuclear counterstaining.

DETAILED DESCRIPTION

Figure 3:
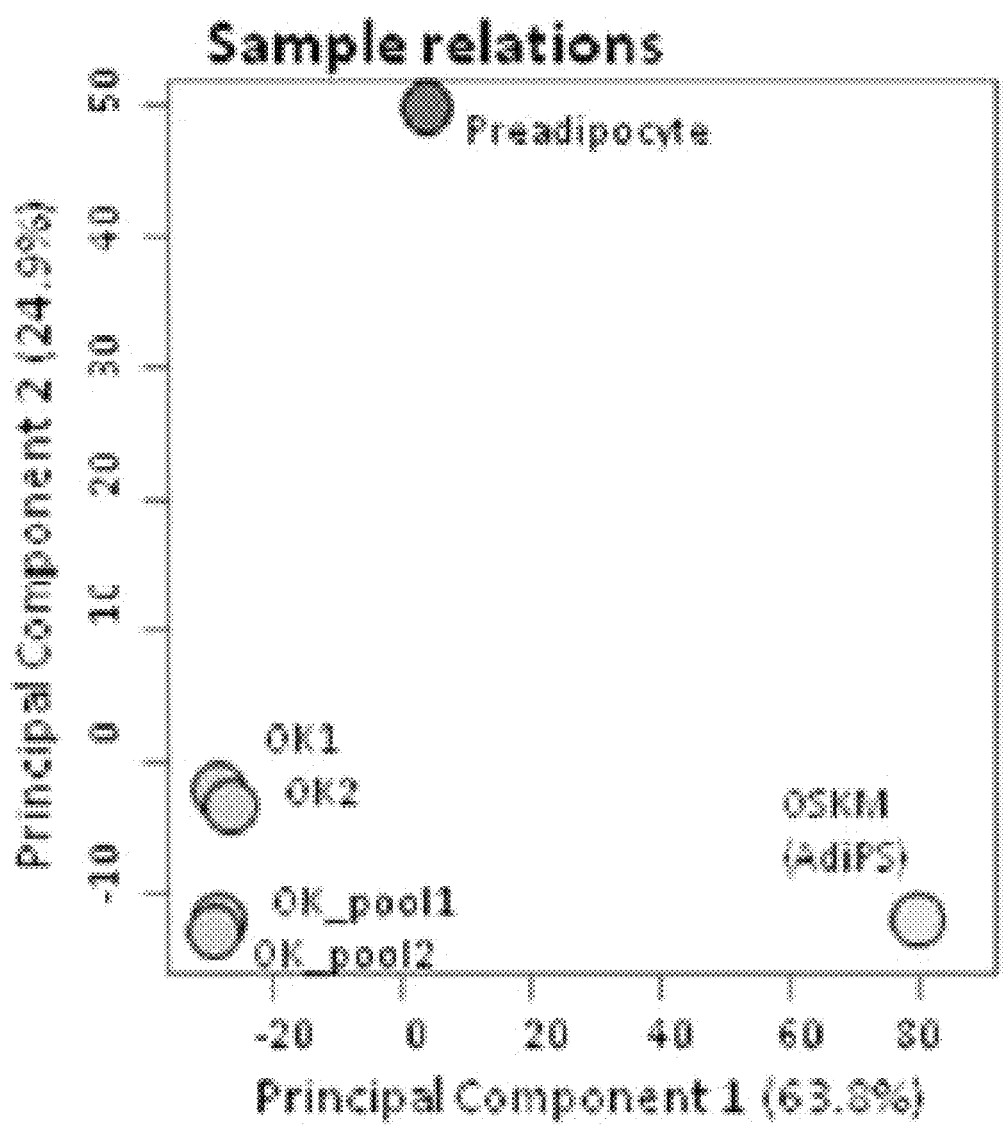
FIG. 3 shows a graph demonstrating principal component analysis on gene expression data of microarray displays distinct cell populations (preadipocyte, OK; single clone, OK_pool; mixed colonies, AdiPS; iPS cell) and clustering of replicates (n=2).

Before the present disclosure is described in greater detail, it is to be understood that this disclosure is not limited to particular embodiments described, and as such may, of course, vary. It is also to be understood that the terminology used herein is for the purpose of describing particular embodiments only, and is not intended to be limiting.

Where a range of values is provided, it is understood that each intervening value, to the tenth of the unit of the lower limit unless the context clearly dictates otherwise, between the upper and lower limit of that range and any other stated or intervening value in that stated range, is encompassed within the disclosure. The upper and lower limits of these smaller ranges may independently be included in the smaller ranges and are also encompassed within the disclosure, subject to any specifically excluded limit in the stated range. Where the stated range includes one or both of the limits, ranges excluding either or both of those included limits are also included in the disclosure.

Unless defined otherwise, all technical and scientific terms used herein have the same meaning as commonly understood by one of ordinary skill in the art to which this disclosure belongs. Although any methods and materials similar or equivalent to those described herein can also be used in the practice or testing of the present disclosure, the preferred methods and materials are now described.

All publications and patents cited in this specification are herein incorporated by reference as if each individual publication or patent were specifically and individually indicated to be incorporated by reference and are incorporated herein by reference to disclose and describe the methods and/or materials in connection with which the publications are cited. The citation of any publication is for its disclosure prior to the filing date and should not be construed as an admission that the present disclosure is not entitled to antedate such publication by virtue of prior disclosure. Further, the dates of publication provided could be different from the actual publication dates that may need to be independently confirmed.

As will be apparent to those of skill in the art upon reading this disclosure, each of the individual embodiments described and illustrated herein has discrete components and features which may be readily separated from or combined with the features of any of the other several embodiments without departing from the scope or spirit of the present disclosure. Any recited method can be carried out in the order of events recited or in any other order that is logically possible.

Embodiments of the present disclosure will employ, unless otherwise indicated, techniques of molecular biology, microbiology, nanotechnology, organic chemistry, biochemistry, botany and the like, which are within the skill of the art. Such techniques are explained fully in the literature.

Definitions

As used herein, "about," "approximately," and the like, when used in connection with a numerical variable, generally refers to the value of the variable and to all values of the variable that are within the experimental error (e.g., within the 95% confidence interval for the mean) or within ±10% of the indicated value, whichever is greater.

As used herein, "nucleic acid" and "polynucleotide" generally refer to a string of at least two base-sugar-phosphate combinations and refers to, among others, single- and double-stranded DNA, DNA that is a mixture of single- and double-stranded regions, single- and double-stranded RNA, and RNA that is mixture of single- and double-stranded regions, hybrid molecules comprising DNA and RNA that may be single-stranded or, more typically, double-stranded or a mixture of single- and double-stranded regions. In addition, polynucleotide as used herein refers to triple-stranded regions comprising RNA or DNA or both RNA and DNA. The strands in such regions may be from the same molecule or from different molecules. The regions may include all of one or more of the molecules, but more typically involve only a region of some of the molecules. One of the molecules of a triple-helical region often is an oligonucleotide. "Polynucleotide" and "nucleic acids" also encompasses such chemically, enzymatically or metabolically modified forms of polynucleotides, as well as the chemical forms of DNA and RNA characteristic of viruses and cells, including simple and complex cells, inter alia. For instance, the term polynucleotide includes DNAs or RNAs as described above that contain one or more modified bases. Thus, DNAs or RNAs comprising unusual bases, such as inosine, or modified bases, such as tritylated bases, to name just two examples, are polynucleotides as the term is used herein. "Polynucleotide" and "nucleic acids" also includes PNAs (peptide nucleic acids), phosphorothioates, and other variants of the phosphate backbone of native nucleic acids. Natural nucleic acids have a phosphate backbone, artificial nucleic acids may contain other types of backbones, but contain the same bases. Thus, DNAs or RNAs with backbones modified for stability or for other reasons are "nucleic acids" or "polynucleotide" as that term is intended herein.

As used herein, "deoxyribonucleic acid (DNA)" and "ribonucleic acid (RNA)" can refer to any polyribonucleotide or polydeoxribonucleotide, which may be unmodified RNA or DNA or modified RNA or DNA. RNA may be in the form of a tRNA (transfer RNA), snRNA (small nuclear RNA), rRNA (ribosomal RNA), mRNA (messenger RNA), anti-sense RNA, RNAi (RNA interference construct), siRNA (short interfering RNA), or ribozymes.

As used herein, "nucleic acid sequence" and "oligonucleotide" also encompasses a nucleic acid and polynucleotide as defined above.

As used herein, "DNA molecule" includes nucleic acids/polynucleotides that are made of DNA. Similarly, "RNA molecule" includes nucleic acids/polynucleotides that are made of RNA.

As used herein, "gene" refers to a hereditary unit corresponding to a sequence of DNA that occupies a specific location on a chromosome and that contains the genetic instruction for a characteristic(s) or trait(s) in an organism. The term "gene" encompasses specific nucleotide sequences of a genome that are transcribed into an RNA product and are not translated into a protein as well as those genomic sequences that are transcribed into an RNA product yet are translated into a protein.

As used herein, the terms "exogenous DNA," "exogenous nucleic acid sequence," "exogenous polynucleotide," "exogenous gene (including specifically named genes)" are used interchangeably with the terms "ectopic DNA," "ectopic nucleic acid sequence," "ectopic polynucleotide," "ectopic gene (including specifically named genes)" and refer to a nucleic acid sequence that was introduced into a cell, organism, or organelle via transfection. Exogenous nucleic acids originate from an external source, for instance, the exogenous nucleic acid may be from another cell or organism and/or it may be synthetic and/or recombinant. While an exogenous nucleic acid sometimes originates from a different organism or species, it may also originate from the same species (e.g., an extra copy or recombinant form of a nucleic acid that is introduced into a cell or organism in addition to or as a replacement for the naturally occurring nucleic acid). Typically, the introduced exogenous sequence is a recombinant sequence.

As used herein, the term "recombinant" generally refers to a non-naturally occurring nucleic acid, nucleic acid construct, or polypeptide. Such non-naturally occurring nucleic acids may include natural nucleic acids that have been modified, for example that have deletions, substitutions, inversions, insertions, etc., and/or combinations of nucleic acid sequences of different origin that are joined using molecular biology technologies (e.g., a nucleic acid sequences encoding a "fusion protein" (e.g., a protein or polypeptide formed from the combination of two different proteins or protein fragments), the combination of a nucleic acid encoding a polypeptide to a promoter sequence, where the coding sequence and promoter sequence are from different sources or otherwise do not typically occur together naturally (e.g., a nucleic acid and a constitutive promoter), etc.). Recombinant also refers to the polypeptide encoded by the recombinant nucleic acid. Non-naturally occurring nucleic acids or polypeptides include nucleic acids and polypeptides modified by man.

As used herein, "polypeptides" or "proteins" are as amino acid residue sequences. Those sequences are written left to right in the direction from the amino to the carboxy terminus. In accordance with standard nomenclature, amino acid residue sequences are denominated by either a three letter or a single letter code as indicated as follows: Alanine (Ala, A), Arginine (Arg, R), Asparagine (Asn, N), Aspartic Acid (Asp, D), Cysteine (Cys, C), Glutamine (Gln, Q), Glutamic Acid (Glu, E), Glycine (Gly, G), Histidine (His, H), Isoleucine (Ile, I), Leucine (Leu, L), Lysine (Lys, K), Methionine (Met, M), Phenylalanine (Phe, F), Proline (Pro, P), Serine (Ser, S), Threonine (Thr, T), Tryptophan (Trp, W), Tyrosine (Tyr, Y), and Valine (Val, V).

As used herein, "plasmid" as used herein refers to a non-chromosomal double-stranded DNA sequence including an intact "replicon" such that the plasmid is replicated in a host cell.

As used herein, the term "vector" or is used in reference to a vehicle used to introduce an exogenous nucleic acid sequence into a cell. A vector may include a DNA molecule, linear or circular (e.g. plasmids), which includes a segment encoding a polypeptide of interest operatively linked to additional segments that provide for its transcription and translation upon introduction into a host cell or host cell organelles. Such additional segments may include promoter and terminator sequences, and may also include one or more origins of replication, one or more selectable markers, an enhancer, a polyadenylation signal, etc. Expression vectors are generally derived from yeast or bacterial genomic or plasmid DNA, or viral DNA, or may contain elements of both.

As used herein, "promoter" includes all sequences capable of driving transcription of a gene. In particular, the term "promoter" as used herein can refer to a DNA sequence generally described as the 5' regulator region of a gene, located proximal to the start codon. The transcription of an adjacent gene sequence is initiated at the promoter region. The term "promoter" also includes fragments of a promoter that are functional in initiating transcription of the gene. The term "promoter" can encompass constitutive promoters and inducible promoters.

As used herein, "constitutive promoter" is a promoter that allows for continual or ubiquitous transcription of its associated gene or polynucleotide. Constitutive promoters are generally are unregulated by cell or tissue type, time, or environment.

As used herein, "inducible promoter" is a promoter that allows transcription of its associated gene or polynucleotide in response to a substance or compound (e.g. an antibiotic, or metal), an environmental condition (e.g. temperature), developmental stage, or tissue type.

As used herein, "wild-type" is the average form of an organism, variety, strain, gene, protein, or characteristic as it occurs in a given population in nature, as distinguished from mutant forms that may result from selective breeding, recombinant engineering, and/or transformation with a transgene.

As used herein, "operatively linked" indicates that the regulatory sequences useful for expression of the coding sequences of a nucleic acid are placed in the nucleic acid molecule in the appropriate positions relative to the coding sequence so as to effect expression of the coding sequence. This same definition is sometimes applied to the arrangement of coding sequences and transcription control elements (e.g. promoters, enhancers, and termination elements), and/or selectable markers in an expression vector.

As used herein, "expression" as used herein describes the process undergone by a structural gene to produce an RNA molecule and/or polypeptide. It can refer to the combination of transcription and translation. Expression can refer to the "expression" of a nucleic acid to produce a RNA molecule and can also refers to "expression" of a polypeptide, indicating that the polypeptide is being produced via expression of the corresponding nucleic acid.

As used herein, "control" is an alternative subject or sample used in an experiment for comparison purposes and included to minimize or distinguish the effect of variables other than an independent variable. A "control" can be a positive control, a negative control, or an assay or reaction control (an internal control to an assay or reaction included to confirm that the assay was functional). In some instances, the positive or negative control can also be the assay or reaction control.

As used interchangeably herein, "subject," "individual," or "patient," refers to a vertebrate, preferably a mammal, more preferably a human. Mammals include, but are not limited to, murines, simians, humans, farm animals, sport animals, and pets. The term "pet" includes a dog, cat, guinea pig, mouse, rat, rabbit, ferret, and the like. The term farm animal includes a horse, sheep, goat, chicken, pig, cow, donkey, llama, alpaca, turkey, and the like.

As used herein, "passage," "passaging" and the like, is a term of art that, in the context of cell culture, can refer to the process of subculturing a population of cells and includes physically removing a subset of cells from a cell population and expanding the subset separately from the original population in a fresh culture environment. As used herein "passaging" does not include simple media changes where no subset of the original population is isolated and propagated.

As used herein, "expansion" or "expanded" in the context of cells, refers to an increase in the number of a characteristic cell type, or cell types, from an initial population of cells, which may or may not be identical. The initial cells used for expansion need not be the same as the cells generated from expansion. For instance, the expanded cells may be produced by ex vivo or in vitro growth and differentiation of the initial population of cells. Expansion can also refer to allowing a cell population to undergo one or more cell division without passaging the cells.

As used herein, the abbreviation "Oct4" can refer to octamer-binding transcription factor 4 gene, gene product, and/or protein. Oct4 can be involved in the self-renewal of undifferentiated embryonic stem cells. One of ordinary skill in the art will instantly appreciate RNA and protein variants, homologues, orthologues, and analogues of the Oct4 in humans and animals. For example, the Oct4 mRNA can have a nucleotide sequence as specified by, but not limited to, any of GenBank Accession numbers NM_203289, NM_001173531, NM_001285986, NM_001285987.1, NM_002701, NM_001252452, and NM_013633. Other mRNA sequences that can be translated to form an Oct4 protein or variant thereof in human or other animal species can be identified and detected by one of ordinary skill in the art using techniques generally known to one of ordinary skill in the art. Similarly, Oct4 protein can have a polypeptide sequences as specified by, but not limited to, any of GenBank Accession numbers NP_001272916.1, NP_002692.2, NP_001272915.1, and NP_038661.2. Other Oct4 polypeptides in human or other animal species can be identified and detected by one of ordinary skill in the art using techniques generally known to one of ordinary skill in the art.

As used herein, the abbreviation "Klf4", can refer to krupppel-like factor 4 gene, gene product, and/or protein. One of ordinary skill in the art will instantly appreciate RNA and protein variants, homologues, orthologues, and analogues of the Klf4 in humans and animals. For example, the Klf4 mRNA can have a nucleotide sequence as specified by, but not limited to, any of GenBank Accession numbers NM_001314052 and NM_010637. Other mRNA sequences that can be translated to form a Klf4 protein or variant thereof in human or other animal species can be identified and detected by one of ordinary skill in the art using techniques generally known to one of ordinary skill in the art. Similarly, Klf4 protein can have a polypeptide sequences as specified by, but not limited to, any of GenBank Accession numbers NP_004226.3, NP_001300981.1, and NP_034767.2. Other Klf4 polypeptides in human or other animal species can be identified and detected by one of ordinary skill in the art using techniques generally known to one of ordinary skill in the art.

As used herein the abbreviation "Sox2" can refer to SRY(sex determining region Y)-box 2 gene, gene product, and/or protein. One of ordinary skill in the art will instantly appreciate RNA and protein variants, homologues, orthologues, and analogues of the Sox2 in humans and animals. For example, the Sox2 mRNA can have a nucleotide sequence as specified by, but not limited to, any of GenBank Accession numbers NM_003106 and NM_011443. Other mRNA sequences that can be translated to form a Sox2 protein or variant thereof in human or other animal species can be identified and detected by one of ordinary skill in the art using techniques generally known to one of ordinary skill in the art. Similarly, Sox2 protein can have a polypeptide sequences as specified by, but not limited to, any of GenBank Accession numbers NP_003097.1 and NP_035573.3. Other Sox2 polypeptides in human or other animal species can be identified and detected by one of ordinary skill in the art using techniques generally known to one of ordinary skill in the art.

As used herein the abbreviation "cMyc" can refer to the Myc molecule gene, gene product, and/or protein. One of ordinary skill in the art will instantly appreciate RNA and protein variants, homologues, orthologues, and analogues of the cMyc in humans and animals. For example, the cMyc mRNA can have a nucleotide sequence as specified by, but not limited to, any of GenBank Accession numbers NM_002467 and NM_001177352, NM_001177353, NM_001177354, and NM_010849. Other mRNA sequences that can be translated to form a cMyc protein or variant thereof in human or other animal species can be identified and detected by one of ordinary skill in the art using techniques generally known to one of ordinary skill in the art. Similarly, cMyc protein can have a polypeptide sequences as specified by, but not limited to, any of GenBank Accession numbers NP_002458.2, NP_001170823.1, NP_001170824.1, and NP_001170825.1. Other cMyc polypeptides in human or other animal species can be identified and detected by one of ordinary skill in the art using techniques generally known to one of ordinary skill in the art.

As used herein, the abbreviation "CNTN1" can refer to contactin 1 gene, gene product, and/or protein. One of ordinary skill in the art will instantly appreciate RNA and protein variants, homologues, orthologues, and analogues of the CNTN1 in humans and animals. For example, the CNTN1 mRNA can have a nucleotide sequence as specified by, but not limited to, any of GenBank Accession numbers NM_001256063 and NM_001256064, NM_001843, NM_175038, NM_001159647, NM_001159648, and NM_007727. Other mRNA sequences that can be translated to form a CNTN1 protein or variant thereof in human or other animal species can be identified and detected by one of ordinary skill in the art using techniques generally known to one of ordinary skill in the art. Similarly, CNTN1 protein can have a polypeptide sequences as specified by, but not limited to, any of GenBank Accession numbers NP_001242992.1, NP_001242993.1, NP_001834.2, NP_778203.1, NP_001153119.1, NP_001153120.1, NP_031753.1. Other CNTN1 polypeptides in human or other animal species can be identified and detected by one of ordinary skill in the art using techniques generally known to one of ordinary skill in the art.

As used herein, the abbreviation "PCSK1" can refer to proprotein convertase 1 gene, gene product, and/or protein. One of ordinary skill in the art will instantly appreciate RNA and protein variants, homologues, orthologues, and analogues of the PCSK1 in humans and animals. For example, the PCSK1 mRNA can have a nucleotide sequence as specified by, but not limited to, any of GenBank Accession numbers NM_001177876.1, NM_000439, NM_001177875, and NM_013628. Other mRNA sequences that can be translated to form a PCSK1 protein or variant thereof in human or other animal species can be identified and detected by one of ordinary skill in the art using techniques generally known to one of ordinary skill in the art. Similarly, PCSK1 protein can have a polypeptide sequences as specified by, but not limited to, any of GenBank Accession numbers NP_000430.3, NP_001171346.1, and NP_038656.1. Other PCSK1 polypeptides in human or other animal species can be identified and detected by one of ordinary skill in the art using techniques generally known to one of ordinary skill in the art.

As used herein, the abbreviation "PDK4" can refer to pyruvate dehydrogenase kinase isozyme 4 gene, gene product, and/or protein. One of ordinary skill in the art will instantly appreciate RNA and protein variants, homologues, orthologues, and analogues of the PDK4 in humans and animals. For example, the PDK4 mRNA can have a nucleotide sequence as specified by, but not limited to, any of GenBank Accession number(s) NM_002612. Other mRNA sequences that can be translated to form a PDK4 protein or variant thereof in human or other animal species can be identified and detected by one of ordinary skill in the art using techniques generally known to one of ordinary skill in the art. Similarly, PDK4 protein can have a polypeptide sequences as specified by, but not limited to, any of GenBank Accession number(s) NP_002603.1. Other PDK4 polypeptides in human or other animal species can be identified and detected by one of ordinary skill in the art using techniques generally known to one of ordinary skill in the art.

As used herein, the abbreviation "RGS4" can refer to regulator of G protein signaling gene, gene product, and/or protein. One of ordinary skill in the art will instantly appreciate RNA and protein variants, homologues, orthologues, and analogues of the RGS4 in humans and animals. For example, the RGS4 mRNA can have a nucleotide sequence as specified by, but not limited to, any of GenBank Accession number(s) NM_001102445, NM_001113380, NM_001113381, NM_005613, and NM_009062. Other mRNA sequences that can be translated to form a RGS4 protein or variant thereof in human or other animal species can be identified and detected by one of ordinary skill in the art using techniques generally known to one of ordinary skill in the art. Similarly, RGS4 protein can have a polypeptide sequences as specified by, but not limited to, any of GenBank Accession number(s) NP_001095915.1, NP_001106851.1, NP_001106582.1, NP_005604.1, and NP_033088.2. Other RGS4 polypeptides in human or other animal species can be identified and detected by one of ordinary skill in the art using techniques generally known to one of ordinary skill in the art.

As used herein, the abbreviation "IRX2" can refer to Iroquois-class homeodomain gene and/or protein gene, gene product, and/or protein. One of ordinary skill in the art will instantly appreciate RNA and protein variants, homologues, orthologues, and analogues of the IRX2 in humans and animals. For example, the IRX2 mRNA can have a nucleotide sequence as specified by, but not limited to, any of GenBank Accession number(s) NM_001134222.1, NM_033267.4, and NM_010574. Other mRNA sequences that can be translated to form an IRX2 protein or variant thereof in human or other animal species can be identified and detected by one of ordinary skill in the art using techniques generally known to one of ordinary skill in the art. Similarly, IRX2 protein can have a polypeptide sequences as specified by, but not limited to, any of GenBank Accession number(s) NP_001127694.1, NP_150366.1, and NP_034704.1 Other IRX2 polypeptides in human or other animal species can be identified and detected by one of ordinary skill in the art using techniques generally known to one of ordinary skill in the art.

As used herein, the abbreviation "LPPR4" can refer to phospholipid phosphatase related 4 (also known as lipid phosphate phosphatase-related protein type 4) gene, gene product, and/or protein. One of ordinary skill in the art will instantly appreciate RNA and protein variants, homologues, orthologues, and analogues of the LPPR4 in humans and animals. For example, the LPPR4 mRNA can have a nucleotide sequence as specified by, but not limited to, any of GenBank Accession number(s) NM_001166252.1 and NM_014839.4. Other mRNA sequences that can be translated to form a LPPR4 protein or variant thereof in human or other animal species can be identified and detected by one of ordinary skill in the art using techniques generally known to one of ordinary skill in the art. Similarly, LPPR4 protein can have a polypeptide sequences as specified by, but not limited to, any of GenBank Accession number(s) NP_001159724.1 and NP_055654.2. Other LPPR4 polypeptides in human or other animal species can be identified and detected by one of ordinary skill in the art using techniques generally known to one of ordinary skill in the art.

As used herein, the abbreviation "LOXL2" can refer to lysyl oxidase like 2 gene, gene product, and/or protein. One of ordinary skill in the art will instantly appreciate RNA and protein variants, homologues, orthologues, and analogues of the LOXL2 in humans and animals. For example, the LOXL2 mRNA can have a nucleotide sequence as specified by, but not limited to, any of GenBank Accession number(s) NM_002318.2. Other mRNA sequences that can be translated to form a LOXL2 protein or variant thereof in human or other animal species can be identified and detected by one of ordinary skill in the art using techniques generally known to one of ordinary skill in the art. Similarly, LOXL2 protein can have a polypeptide sequences as specified by, but not limited to, any of GenBank Accession number(s) NP_002309.1. Other LOXL2 polypeptides in human or other animal species can be identified and detected by one of ordinary skill in the art using techniques generally known to one of ordinary skill in the art.

As used herein, the abbreviation "LOXL4" can refer to lysyl oxidase like 4 gene, gene product, and/or protein. One of ordinary skill in the art will instantly appreciate RNA and protein variants, homologues, orthologues, and analogues of the LOXL4 in humans and animals. For example, the LOXL4 mRNA can have a nucleotide sequence as specified by, but not limited to, any of GenBank Accession number(s) NM_032211.6. Other mRNA sequences that can be translated to form a LOXL4 protein or variant thereof in human or other animal species can be identified and detected by one of ordinary skill in the art using techniques generally known to one of ordinary skill in the art. Similarly, LOXL4 protein can have a polypeptide sequences as specified by, but not limited to, any of GenBank Accession number(s) NP_115587.6. Other LOXL4 polypeptides in human or other animal species can be identified and detected by one of ordinary skill in the art using techniques generally known to one of ordinary skill in the art.

As used herein, the abbreviation "KCTD12" can refer to the potassium channel teteramerization domain containing 12 gene, gene product, and/or protein. One of ordinary skill in the art will instantly appreciate RNA and protein variants, homologues, orthologues, and analogues of the KCTD12 in humans and animals. For example, the KCTD12 mRNA can have a nucleotide sequence as specified by, but not limited to, any of GenBank Accession number(s) NM_138444.3. Other mRNA sequences that can be translated to form a KCTD12 protein or variant thereof in human or other animal species can be identified and detected by one of ordinary skill in the art using techniques generally known to one of ordinary skill in the art. Similarly, KCTD12 protein can have a polypeptide sequences as specified by, but not limited to, any of GenBank Accession number(s) NP_612453.1. Other KCTD12 polypeptides in human or other animal species can be identified and detected by one of ordinary skill in the art using techniques generally known to one of ordinary skill in the art.

As used herein, the abbreviation "KL" can refer to the Klotho gene, gene product, and/or protein. One of ordinary skill in the art will instantly appreciate RNA and protein variants, homologues, orthologues, and analogues of the KL in humans and animals. For example, the KL mRNA can have a nucleotide sequence as specified by, but not limited to, any of GenBank Accession number(s) NM_004795.3 and NM_153683.2. Other mRNA sequences that can be translated to form a KL protein or variant thereof in human or other animal species can be identified and detected by one of ordinary skill in the art using techniques generally known to one of ordinary skill in the art. Similarly, KL protein can have a polypeptide sequences as specified by, but not limited to, any of GenBank Accession number(s) NP_004786.2. Other KL polypeptides in human or other animal species can be identified and detected by one of ordinary skill in the art using techniques generally known to one of ordinary skill in the art.

As used herein, the abbreviation "RBPJ" can refer to recombination signal binding protein for immunoglobulin kappa J region gene, gene product, and/or protein. One of ordinary skill in the art will instantly appreciate RNA and protein variants, homologues, orthologues, and analogues of the KL in humans and animals. For example, the KL mRNA can have a nucleotide sequence as specified by, but not limited to, any of GenBank Accession number(s) NM_005349.3, NM_015874.4, NM_203283.2, and NM_203284.2. Other mRNA sequences that can be translated to form a KL protein or variant thereof in human or other animal species can be identified and detected by one of ordinary skill in the art using techniques generally known to one of ordinary skill in the art. Similarly, KL protein can have a polypeptide sequences as specified by, but not limited to, any of GenBank Accession number(s) NP_005340.2, NP_056958.3, NP_976028.1, and NP_976029.1. Other KL polypeptides in human or other animal species can be identified and detected by one of ordinary skill in the art using techniques generally known to one of ordinary skill in the art.

As used herein, the abbreviation "Sox9" can refer to SRY-Box 9 gene, gene product, and/or protein. One of ordinary skill in the art will instantly appreciate RNA and protein variants, homologues, orthologues, and analogues of the Sox9 in humans and animals. For example, the Sox9 mRNA can have a nucleotide sequence as specified by, but not limited to, any of GenBank Accession number(s) NM_000346.3. Other mRNA sequences that can be translated to form a Sox9 protein or variant thereof in human or other animal species can be identified and detected by one of ordinary skill in the art using techniques generally known to one of ordinary skill in the art. Similarly, Sox9 protein can have a polypeptide sequences as specified by, but not limited to, any of GenBank Accession number(s) NP_000337.1. Other Sox9 polypeptides in human or other animal species can be identified and detected by one of ordinary skill in the art using techniques generally known to one of ordinary skill in the art.

As used herein, the abbreviation "NeuroD" can refer to neuronal differentiation 1 gene, gene product, and/or protein. One of ordinary skill in the art will instantly appreciate RNA and protein variants, homologues, orthologues, and analogues of the NeuroD in humans and animals. For example, the NeuroD mRNA can have a nucleotide sequence as specified by, but not limited to, any of GenBank Accession number(s) NM_002500.4. Other mRNA sequences that can be translated to form a NeuroD protein or variant thereof in human or other animal species can be identified and detected by one of ordinary skill in the art using techniques generally known to one of ordinary skill in the art. Similarly, NeuroD protein can have a polypeptide sequences as specified by, but not limited to, any of GenBank Accession number(s) NP_002491.2. Other NeuroD polypeptides in human or other animal species can be identified and detected by one of ordinary skill in the art using techniques generally known to one of ordinary skill in the art.

As used herein, the abbreviation "ISL1" can refer to ISL LIM Homeobox 1 gene, gene product, and/or protein. One of ordinary skill in the art will instantly appreciate RNA and protein variants, homologues, orthologues, and analogues of the ISL1 in humans and animals. For example, the ISL1 mRNA can have a nucleotide sequence as specified by, but not limited to, any of GenBank Accession number(s) NM_002202.2. Other mRNA sequences that can be translated to form an ISL1 protein or variant thereof in human or other animal species can be identified and detected by one of ordinary skill in the art using techniques generally known to one of ordinary skill in the art. Similarly, ISL1 protein can have a polypeptide sequences as specified by, but not limited to, any of GenBank Accession number(s) NP_002193.2. Other ISL1 polypeptides in human or other animal species can be identified and detected by one of ordinary skill in the art using techniques generally known to one of ordinary skill in the art.

As used herein, the abbreviation "RGS2" can refer to regulator of G-Protein Signaling 2 gene, gene product, and/or protein. One of ordinary skill in the art will instantly appreciate RNA and protein variants, homologues, orthologues, and analogues of the RGS2 in humans and animals. For example, the RGS2 mRNA can have a nucleotide sequence as specified by, but not limited to, any of GenBank Accession number(s) NM_002923.3. Other mRNA sequences that can be translated to form a RGS2 protein or variant thereof in human or other animal species can be identified and detected by one of ordinary skill in the art using techniques generally known to one of ordinary skill in the art. Similarly, RGS2 protein can have a polypeptide sequences as specified by, but not limited to, any of GenBank Accession number(s) NP_002914.1. Other RGS2 polypeptides in human or other animal species can be identified and detected by one of ordinary skill in the art using techniques generally known to one of ordinary skill in the art.

As used herein, the abbreviation "IL8" can refer to interleukin 8 (also known as C-X-C motif ligand 8) gene, gene product, and/or protein. One of ordinary skill in the art will instantly appreciate RNA and protein variants, homologues, orthologues, and analogues of the IL8 in humans and animals. For example, the IL8 mRNA can have a nucleotide sequence as specified by, but not limited to, any of GenBank Accession number(s) NM_000584.3. Other mRNA sequences that can be translated to form an IL8 protein or variant thereof in human or other animal species can be identified and detected by one of ordinary skill in the art using techniques generally known to one of ordinary skill in the art. Similarly, IL8 protein can have a polypeptide sequences as specified by, but not limited to, any of GenBank Accession number(s) NP_000575.1. Other IL8 polypeptides in human or other animal species can be identified and detected by one of ordinary skill in the art using techniques generally known to one of ordinary skill in the art.

As used herein, the abbreviation "AKAP7" can refer to A-kinase anchoring protein 7 gene, gene product, and/or protein. One of ordinary skill in the art will instantly appreciate RNA and protein variants, homologues, orthologues, and analogues of the AKAP7 in humans and animals. For example, the AKAP7 mRNA can have a nucleotide sequence as specified by, but not limited to, any of GenBank Accession number(s) NM_004842.3, NM_016377.3, and NM_138633.2. Other mRNA sequences that can be translated to form an AKAP7 protein or variant thereof in human or other animal species can be identified and detected by one of ordinary skill in the art using techniques generally known to one of ordinary skill in the art. Similarly, AKAP7 protein can have a polypeptide sequences as specified by, but not limited to, any of GenBank Accession number(s) NP_004833.1, NP_057461.2, and NP_619539.1. Other AKAP7 polypeptides in human or other animal species can be identified and detected by one of ordinary skill in the art using techniques generally known to one of ordinary skill in the art.

As used herein, the abbreviation "CPE" can refer to carboxypeptidase E gene, gene product, and/or protein. One of ordinary skill in the art will instantly appreciate RNA and protein variants, homologues, orthologues, and analogues of the CPE in humans and animals. For example, the CPE mRNA can have a nucleotide sequence as specified by, but not limited to, any of GenBank Accession number(s) NM_001873.3. Other mRNA sequences that can be translated to form a CPE protein or variant thereof in human or other animal species can be identified and detected by one of ordinary skill in the art using techniques generally known to one of ordinary skill in the art. Similarly, CPE protein can have a polypeptide sequences as specified by, but not limited to, any of GenBank Accession number(s) NP_001864.1. Other CPE polypeptides in human or other animal species can be identified and detected by one of ordinary skill in the art using techniques generally known to one of ordinary skill in the art.

As used herein, the abbreviation "OAS1" can refer to 2'-5'-Oligoadenylate Synthetase 1 gene, gene product, and/or protein. One of ordinary skill in the art will instantly appreciate RNA and protein variants, homologues, orthologues, and analogues of the OAS1 in humans and animals. For example, the OAS1 mRNA can have a nucleotide sequence as specified by, but not limited to, any of GenBank Accession number(s) NM_001032409.2, NM_001320151.1, NM_002534.3, and NM_016816.3. Other mRNA sequences that can be translated to form an OAS1 protein or variant thereof in human or other animal species can be identified and detected by one of ordinary skill in the art using techniques generally known to one of ordinary skill in the art. Similarly, OAS1 protein can have a polypeptide sequences as specified by, but not limited to, any of GenBank Accession number(s) NP_001027581.1, NP_001307080.1, NP_002525.2, and NP_058132.2. Other OAS1 polypeptides in human or other animal species can be identified and detected by one of ordinary skill in the art using techniques generally known to one of ordinary skill in the art.

As used herein, the abbreviation "PLTP" can refer to phospholipid transfer protein gene, gene product, and/or protein. One of ordinary skill in the art will instantly appreciate RNA and protein variants, homologues, orthologues, and analogues of the PLTP in humans and animals. For example, the PLTP mRNA can have a nucleotide sequence as specified by, but not limited to, any of GenBank Accession number(s) NM_001242920.1, NM_001242921.1, NM_006227.3, and NM_182676.2. Other mRNA sequences that can be translated to form a PLTP protein or variant thereof in human or other animal species can be identified and detected by one of ordinary skill in the art using techniques generally known to one of ordinary skill in the art. Similarly, PLTP protein can have a polypeptide sequences as specified by, but not limited to, any of GenBank Accession number(s) NP_001229849.1, NP_001229850.1, NP_006218.1, and NP_872617.1. Other PLTP polypeptides in human or other animal species can be identified and detected by one of ordinary skill in the art using techniques generally known to one of ordinary skill in the art.

As used herein, the abbreviation "PGS4" can refer to leucine rich repeat containing 49 gene, gene product, and/or protein. One of ordinary skill in the art will instantly appreciate RNA and protein variants, homologues, orthologues, and analogues of the PGS4 in humans and animals. For example, the PGS4 mRNA can have a nucleotide sequence as specified by, but not limited to, any of GenBank Accession number(s) NM_001199017.2, NM_001199018.2, NM_001284357.1, and NM_017691.4. Other mRNA sequences that can be translated to form a PGS4 protein or variant thereof in human or other animal species can be identified and detected by one of ordinary skill in the art using techniques generally known to one of ordinary skill in the art. Similarly, PGS4 protein can have a polypeptide sequences as specified by, but not limited to, any of GenBank Accession number(s) NP_001185946.1, NP_001185947.1, NP_001271286.1, and NP_060161.2. Other PGS4 polypeptides in human or other animal species can be identified and detected by one of ordinary skill in the art using techniques generally known to one of ordinary skill in the art.

As used herein, the abbreviation "RNF128" can refer to ring finger protein 128 gene, gene product, and/or protein. One of ordinary skill in the art will instantly appreciate RNA and protein variants, homologues, orthologues, and analogues of the RNF128 in humans and animals. For example, the RNF128 mRNA can have a nucleotide sequence as specified by, but not limited to, any of GenBank Accession number(s) NM_024539.3 and NM_194463.1. Other mRNA sequences that can be translated to form a RNF128 protein or variant thereof in human or other animal species can be identified and detected by one of ordinary skill in the art using techniques generally known to one of ordinary skill in the art. Similarly, RNF128 protein can have a polypeptide sequences as specified by, but not limited to, any of GenBank Accession number(s) NP_078815.3 and NP_919445.1. Other RNF128 polypeptides in human or other animal species can be identified and detected by one of ordinary skill in the art using techniques generally known to one of ordinary skill in the art.

As used herein, the abbreviation "BEX1" can refer to brain expressed X-linked 1 gene, gene product, and/or protein. One of ordinary skill in the art will instantly appreciate RNA and protein variants, homologues, orthologues, and analogues of the BEX1 in humans and animals. For example, the BEX1 mRNA can have a nucleotide sequence as specified by, but not limited to, any of GenBank Accession number(s) NM_018476.3. Other mRNA sequences that can be translated to form a BEX1 protein or variant thereof in human or other animal species can be identified and detected by one of ordinary skill in the art using techniques generally known to one of ordinary skill in the art. Similarly, BEX1 protein can have a polypeptide sequences as specified by, but not limited to, any of GenBank Accession number(s) NP_060946.3. Other BEX1 polypeptides in human or other animal species can be identified and detected by one of ordinary skill in the art using techniques generally known to one of ordinary skill in the art.

As used herein, the abbreviation "HDAC9" can refer to histone deacetylase 9 gene, gene product, and/or protein. One of ordinary skill in the art will instantly appreciate RNA and protein variants, homologues, orthologues, and analogues of the HDAC9 in humans and animals. For example, the HDAC9 mRNA can have a nucleotide sequence as specified by, but not limited to, any of GenBank Accession number(s) NM_001204144.2, NM_001204145.2, NM_001204146.2, NM_001204147.2, and NM_001204148.2. Other mRNA sequences that can be translated to form a HDAC9 protein or variant thereof in human or other animal species can be identified and detected by one of ordinary skill in the art using techniques generally known to one of ordinary skill in the art. Similarly, HDAC9 protein can have a polypeptide sequences as specified by, but not limited to, any of GenBank Accession number(s) NP_001191073.1, NP_001191074.1, NP_001191075.1, NP_001191076.1, NP_001191077.1, NP_001308797.1, NP_001308798.1, NP_001308799.1, NP_001308800.1, NP_001308801.1, NP_001308802.1, NP_001308803.1, NP_001308804.1, NP_001308805.1, NP_001308806.1, NP_001308807.1, NP_001308808.1, NP_001308813.1, NP_001308814.1, NP_001308815.1, NP_001308816.1, NP_001308817.1, NP_001308818.1, NP_001308819.1, NP_001308820.1, NP_001308822.1, NP_001308823.1, NP_001308824.1, NP_001308825.1, NP_001308826.1, NP_001308827.1, NP_001308828.1, NP_001308829.1, NP_001308830.1, NP_001308831.1, NP_055522.1, NP_478056.1, and NP_848510.1, NP_848512.1. Other HDAC9 polypeptides in human or other animal species can be identified and detected by one of ordinary skill in the art using techniques generally known to one of ordinary skill in the art.

As used herein, the abbreviation "KCNJ2" cam refer to potassium voltage-gated channel subfamily J member 2 gene, gene product, and/or protein. One of ordinary skill in the art will instantly appreciate RNA and protein variants, homologues, orthologues, and analogues of the KCNJ2 in humans and animals. For example, the KCNJ2 mRNA can have a nucleotide sequence as specified by, but not limited to, any of GenBank Accession number(s) NM_000891.2. Other mRNA sequences that can be translated to form a KCNJ2 protein or variant thereof in human or other animal species can be identified and detected by one of ordinary skill in the art using techniques generally known to one of ordinary skill in the art. Similarly, KCNJ2 protein can have a polypeptide sequences as specified by, but not limited to, any of GenBank Accession number(s) NP_000882.1. Other KCNJ2 polypeptides in human or other animal species can be identified and detected by one of ordinary skill in the art using techniques generally known to one of ordinary skill in the art.

As used herein, the abbreviation "CD36" can refer to the CD36 molecule gene, gene product, and/or protein. One of ordinary skill in the art will instantly appreciate RNA and protein variants, homologues, orthologues, and analogues of the CD36 in humans and animals. For example, the CD36 mRNA can have a nucleotide sequence as specified by, but not limited to, any of GenBank Accession number(s) NM_000072.3, NM_001001547.2, NM_001001548.2, NM_001127443.1, NM_001127444.1, NM_001289908.1, NM_001289909.1, and NM_001289911.1. Other mRNA sequences that can be translated to form a CD36 protein or variant thereof in human or other animal species can be identified and detected by one of ordinary skill in the art using techniques generally known to one of ordinary skill in the art. Similarly, CD36 protein can have a polypeptide sequences as specified by, but not limited to, any of GenBank Accession number(s) NP_000063.2, NP_001001547.1, NP_001001548.1, NP_001120915.1, NP_001120916.1, NP_001276837.1, NP_001276838.1, and NP_001276840.1. Other CD36 polypeptides in human or other animal species can be identified and detected by one of ordinary skill in the art using techniques generally known to one of ordinary skill in the art.

As used herein, the abbreviation "FABP4" can refer to the fatty acid binding protein 4 gene, gene product, and/or protein. One of ordinary skill in the art will instantly appreciate RNA and protein variants, homologues, orthologues, and analogues of the FABP4 in humans and animals. For example, the FABP4 mRNA can have a nucleotide sequence as specified by, but not limited to, any of GenBank Accession number(s) NM_001442.2. Other mRNA sequences that can be translated to form a FABP4 protein or variant thereof in human or other animal species can be identified and detected by one of ordinary skill in the art using techniques generally known to one of ordinary skill in the art. Similarly, FABP4 protein can have a polypeptide sequences as specified by, but not limited to, any of GenBank Accession number(s) NP_001433.1. Other FABP4 polypeptides in human or other animal species can be identified and detected by one of ordinary skill in the art using techniques generally known to one of ordinary skill in the art.

As used herein, the abbreviation "CD71" can refer to the transferrin receptor gene, gene product, and/or protein. One of ordinary skill in the art will instantly appreciate RNA and protein variants, homologues, orthologues, and analogues of the CD71 in humans and animals. For example, the CD71 mRNA can have a nucleotide sequence as specified by, but not limited to, any of GenBank Accession number(s) NM_001128148.2, NM_001313965.1, NM_001313966.1, and NM_003234.3. Other mRNA sequences that can be translated to form a CD71 protein or variant thereof in human or other animal species can be identified and detected by one of ordinary skill in the art using techniques generally known to one of ordinary skill in the art. Similarly, CD71 protein can have a polypeptide sequences as specified by, but not limited to, any of GenBank Accession number(s) NP_001121620.1, NP_001300894.1, NP_001300895.1, and NP_003225.2. Other CD71 polypeptides in human or other animal species can be identified and detected by one of ordinary skill in the art using techniques generally known to one of ordinary skill in the art.

As used herein, the abbreviation "CHST2" can refer to the carbohydrate sulfotransferase 2 gene, gene product, and/or protein. One of ordinary skill in the art will instantly appreciate RNA and protein variants, homologues, orthologues, and analogues of the CHST2 in humans and animals. For example, the CHST2 mRNA can have a nucleotide sequence as specified by, but not limited to, any of GenBank Accession number(s) NM_004267.4. Other mRNA sequences that can be translated to form a CHST2 protein or variant thereof in human or other animal species can be identified and detected by one of ordinary skill in the art using techniques generally known to one of ordinary skill in the art. Similarly, CHST2 protein can have a polypeptide sequences as specified by, but not limited to, any of GenBank Accession number(s) NP_004258.2. Other CHST2 polypeptides in human or other animal species can be identified and detected by one of ordinary skill in the art using techniques generally known to one of ordinary skill in the art.

As used herein, the abbreviation "AMPD3" can refer to the adenosine monophosphate deaminase 3 gene, gene product, and/or protein. One of ordinary skill in the art will instantly appreciate RNA and protein variants, homologues, orthologues, and analogues of the AMPD3 in humans and animals. For example, the AMPD3 mRNA can have a nucleotide sequence as specified by, but not limited to, any of GenBank Accession number(s) NM_000480.2 NM_001025389.1 NM_001025390.1 NM_001172430.1 NM_001172431.1. Other mRNA sequences that can be translated to form an AMPD3 protein or variant thereof in human or other animal species can be identified and detected by one of ordinary skill in the art using techniques generally known to one of ordinary skill in the art. Similarly, AMPD3 protein can have a polypeptide sequences as specified by, but not limited to, any of GenBank Accession number(s) NP_000471.1, NP_001020560.1, NP_001020561.1, NP_001165901.1, and NP_001165902.1. Other AMPD3 polypeptides in human or other animal species can be identified and detected by one of ordinary skill in the art using techniques generally known to one of ordinary skill in the art.

As used herein, the abbreviation "CD58" can refer to the CD58 molecule gene, gene product, and/or protein. One of ordinary skill in the art will instantly appreciate RNA and protein variants, homologues, orthologues, and analogues of the CD58 in humans and animals. For example, the CD58 mRNA can have a nucleotide sequence as specified by, but not limited to, any of GenBank Accession number(s) NM_001144822.1 and NM_001779.2. Other mRNA sequences that can be translated to form a CD58 protein or variant thereof in human or other animal species can be identified and detected by one of ordinary skill in the art using techniques generally known to one of ordinary skill in the art. Similarly, CD58 protein can have a polypeptide sequences as specified by, but not limited to, any of GenBank Accession number(s) NP_001138294.1 and NP_001770.1. Other CD58 polypeptides in human or other animal species can be identified and detected by one of ordinary skill in the art using techniques generally known to one of ordinary skill in the art.

As used herein, the abbreviation "MINPP1" can refer to the multiple inositol-polyphosphate phosphatase 1 gene, gene product, and/or protein. One of ordinary skill in the art will instantly appreciate RNA and protein variants, homologues, orthologues, and analogues of the MINPP1 in humans and animals. For example, the MINPP1 mRNA can have a nucleotide sequence as specified by, but not limited to, any of GenBank Accession number(s) NM_001178117.1, NM_001178118.1, and NM_004897.4. Other mRNA sequences that can be translated to form a MINPP1 protein or variant thereof in human or other animal species can be identified and detected by one of ordinary skill in the art using techniques generally known to one of ordinary skill in the art. Similarly, MINPP1 protein can have a polypeptide sequences as specified by, but not limited to, any of GenBank Accession number(s) NP_001171588.1, NP_001171589.1, and NP_004888.2. Other MINPP1 polypeptides in human or other animal species can be identified and detected by one of ordinary skill in the art using techniques generally known to one of ordinary skill in the art.

As used herein, the abbreviation "IDH2" can refer to the isocitrate dehydrogenase (NADP(+))2 gene, gene product, and/or protein. One of ordinary skill in the art will instantly appreciate RNA and protein variants, homologues, orthologues, and analogues of the IDH2 in humans and animals. For example, the IDH2 mRNA can have a nucleotide sequence as specified by, but not limited to, any of GenBank Accession number(s) NM_001289910.1, NM_001290114.1, and NM_002168.3. Other mRNA sequences that can be translated to form an IDH2 protein or variant thereof in human or other animal species can be identified and detected by one of ordinary skill in the art using techniques generally known to one of ordinary skill in the art. Similarly, IDH2 protein can have a polypeptide sequences as specified by, but not limited to, any of GenBank Accession number(s) NP_001276839.1, NP_001277043.1, and NP_002159.2. Other IDH2 polypeptides in human or other animal species can be identified and detected by one of ordinary skill in the art using techniques generally known to one of ordinary skill in the art.

As used herein, the abbreviation "CD70" can refer to the CD70 Molecule (also referred to as tumor necrosis factor (ligand) superfamily, member 70) gene, gene product, and/or protein. One of ordinary skill in the art will instantly appreciate RNA and protein variants, homologues, orthologues, and analogues of the CD70 in humans and animals. For example, the CD70 mRNA can have a nucleotide sequence as specified by, but not limited to, any of GenBank Accession number(s) NM_001252.4. Other mRNA sequences that can be translated to form a CD70 protein or variant thereof in human or other animal species can be identified and detected by one of ordinary skill in the art using techniques generally known to one of ordinary skill in the art. Similarly, CD70 protein can have a polypeptide sequences as specified by, but not limited to, any of GenBank Accession number(s) NP_001243.1. Other CD70 polypeptides in human or other animal species can be identified and detected by one of ordinary skill in the art using techniques generally known to one of ordinary skill in the art.

As used herein, the abbreviation "HLA-DRA" can refer to the major histocompatibility complex, Class II, DR alpha gene, gene product, and/or protein. One of ordinary skill in the art will instantly appreciate RNA and protein variants, homologues, orthologues, and analogues of the HLA-DRA in humans and animals. For example, the HLA-DRA mRNA can have a nucleotide sequence as specified by, but not limited to, any of GenBank Accession number(s) NM_019111.4. Other mRNA sequences that can be translated to form a HLA-DRA protein or variant thereof in human or other animal species can be identified and detected by one of ordinary skill in the art using techniques generally known to one of ordinary skill in the art. Similarly, HLA-DRA protein can have a polypeptide sequences as specified by, but not limited to, any of GenBank Accession number(s) NP_061984.2. Other HLA-DRA polypeptides in human or other animal species can be identified and detected by one of ordinary skill in the art using techniques generally known to one of ordinary skill in the art.

As used herein, the abbreviation "NX1" can refer to the neurexin 1 gene, gene product, and/or protein. One of ordinary skill in the art will instantly appreciate RNA and protein variants, homologues, orthologues, and analogues of the NX1 in humans and animals. For example, the NX1 mRNA can have a nucleotide sequence as specified by, but not limited to, any of GenBank Accession number(s) NM_001135659.2, NM_001320156.2, NM_001320157.3, NM_004801.5, and NM_138735.4. Other mRNA sequences that can be translated to form a NX1 protein or variant thereof in human or other animal species can be identified and detected by one of ordinary skill in the art using techniques generally known to one of ordinary skill in the art. Similarly, NX1 protein can have a polypeptide sequences as specified by, but not limited to, any of GenBank Accession number(s) NP_001129131.1, NP_001307085.1, NP_001307086.1, NP_004792.1, and NP_620072.1. Other NX1 polypeptides in human or other animal species can be identified and detected by one of ordinary skill in the art using techniques generally known to one of ordinary skill in the art.

As used herein, the abbreviation "CD83" can refer to the CD83 molecule gene, gene product, and/or protein. One of ordinary skill in the art will instantly appreciate RNA and protein variants, homologues, orthologues, and analogues of the CD83 in humans and animals. For example, the CD83 mRNA can have a nucleotide sequence as specified by, but not limited to, any of GenBank Accession number(s) NM_001040280.1, NM_001251901.1, and NM_004233.3. Other mRNA sequences that can be translated to form a CD83 protein or variant thereof in human or other animal species can be identified and detected by one of ordinary skill in the art using techniques generally known to one of ordinary skill in the art. Similarly, CD83 protein can have a polypeptide sequences as specified by, but not limited to, any of GenBank Accession number(s) NP_001035370.1, NP_001238830.1, and NP_004224.1. Other CD83 polypeptides in human or other animal species can be identified and detected by one of ordinary skill in the art using techniques generally known to one of ordinary skill in the art.

As used herein, the abbreviation "CD74" can refer to the CD74 molecule gene, gene product, and/or protein. One of ordinary skill in the art will instantly appreciate RNA and protein variants, homologues, orthologues, and analogues of the CD74 in humans and animals. For example, the CD74 mRNA can have a nucleotide sequence as specified by, but not limited to, any of GenBank Accession number(s) NM_001025158.2, NM_001025159.2, and NM_004355.3. Other mRNA sequences that can be translated to form a CD74 protein or variant thereof in human or other animal species can be identified and detected by one of ordinary skill in the art using techniques generally known to one of ordinary skill in the art. Similarly, CD74 protein can have a polypeptide sequences as specified by, but not limited to, any of GenBank Accession number(s) NP_001020329.1, NP_001020330.1, and NP_004346.1. Other CD74 polypeptides in human or other animal species can be identified and detected by one of ordinary skill in the art using techniques generally known to one of ordinary skill in the art.

As used herein, the abbreviation "IFI44L" can refer to the interferon induced protein 44 like gene, gene product, and/or protein. One of ordinary skill in the art will instantly appreciate RNA and protein variants, homologues, orthologues, and analogues of the IFI44L in humans and animals. For example, the IFI44L mRNA can have a nucleotide sequence as specified by, but not limited to, any of GenBank Accession number(s) NM_006820.3. Other mRNA sequences that can be translated to form an IFI44L protein or variant thereof in human or other animal species can be identified and detected by one of ordinary skill in the art using techniques generally known to one of ordinary skill in the art. Similarly, IFI44L protein can have a polypeptide sequences as specified by, but not limited to, any of GenBank Accession number(s) NP_006811.2. Other IFI44L polypeptides in human or other animal species can be identified and detected by one of ordinary skill in the art using techniques generally known to one of ordinary skill in the art.

As used herein, the abbreviation "BST2" can refer to the bone marrow stromal cell antigen 2 gene, gene product, and/or protein. One of ordinary skill in the art will instantly appreciate RNA and protein variants, homologues, orthologues, and analogues of the BST2 in humans and animals. For example, the BST2 mRNA can have a nucleotide sequence as specified by, but not limited to, any of GenBank Accession number(s) NM_004335.3. Other mRNA sequences that can be translated to form a BST2 protein or variant thereof in human or other animal species can be identified and detected by one of ordinary skill in the art using techniques generally known to one of ordinary skill in the art. Similarly, BST2 protein can have a polypeptide sequences as specified by, but not limited to, any of GenBank Accession number(s) NP_004326.1. Other BST2 polypeptides in human or other animal species can be identified and detected by one of ordinary skill in the art using techniques generally known to one of ordinary skill in the art.

As used herein, the abbreviation "ISG15" can refer to the ISG15 ubiquitin-like modifier gene, gene product, and/or protein. One of ordinary skill in the art will instantly appreciate RNA and protein variants, homologues, orthologues, and analogues of the ISG15 in humans and animals. For example, the ISG15 mRNA can have a nucleotide sequence as specified by, but not limited to, any of GenBank Accession number(s) NM_005101.3. Other mRNA sequences that can be translated to form an ISG15 protein or variant thereof in human or other animal species can be identified and detected by one of ordinary skill in the art using techniques generally known to one of ordinary skill in the art. Similarly, ISG15 protein can have a polypeptide sequences as specified by, but not limited to, any of GenBank Accession number(s) NP_005092.1. Other ISG15 polypeptides in human or other animal species can be identified and detected by one of ordinary skill in the art using techniques generally known to one of ordinary skill in the art.

As used herein, the abbreviation "CLIC6" can refer to the chloride intracellular channel 6 gene, gene product, and/or protein. One of ordinary skill in the art will instantly appreciate RNA and protein variants, homologues, orthologues, and analogues of the CLIC6 in humans and animals. For example, the CLIC6 mRNA can have a nucleotide sequence as specified by, but not limited to, any of GenBank Accession number(s) NM_001317009.1 and NM_053277.2. Other mRNA sequences that can be translated to form a CLIC6 protein or variant thereof in human or other animal species can be identified and detected by one of ordinary skill in the art using techniques generally known to one of ordinary skill in the art. Similarly, CLIC6 protein can have a polypeptide sequences as specified by, but not limited to, any of GenBank Accession number(s) NP_001303938.1 and NP_444507.1. Other CLIC6 polypeptides in human or other animal species can be identified and detected by one of ordinary skill in the art using techniques generally known to one of ordinary skill in the art.

As used herein, the abbreviation "PBX3" can refer to the pre-B-Cell Leukemia Homeobox 3 gene, gene product, and/or protein. One of ordinary skill in the art will instantly appreciate RNA and protein variants, homologues, orthologues, and analogues of the PBX3 in humans and animals. For example, the PBX3 mRNA can have a nucleotide sequence as specified by, but not limited to, any of GenBank Accession number(s) NM_001134778.1 and NM_006195.5. Other mRNA sequences that can be translated to form a PBX3 protein or variant thereof in human or other animal species can be identified and detected by one of ordinary skill in the art using techniques generally known to one of ordinary skill in the art. Similarly, PBX3 protein can have a polypeptide sequences as specified by, but not limited to, any of GenBank Accession number(s) NP_001128250.1 and NP_006186.1. Other PBX3 polypeptides in human or other animal species can be identified and detected by one of ordinary skill in the art using techniques generally known to one of ordinary skill in the art.

As used herein, the abbreviation "TOX2" can refer to TOX high mobility group box family member 2 gene, gene product, and/or protein. One of ordinary skill in the art will instantly appreciate RNA and protein variants, homologues, orthologues, and analogues of the TOX2 in humans and animals. For example, the TOX2 mRNA can have a nucleotide sequence as specified by, but not limited to, any of GenBank Accession number(s) NM_001098796.1, NM_001098797.1, NM_001098798.1, and NM_032883.2. Other mRNA sequences that can be translated to form a TOX2 protein or variant thereof in human or other animal species can be identified and detected by one of ordinary skill in the art using techniques generally known to one of ordinary skill in the art. Similarly, TOX2 protein can have a polypeptide sequences as specified by, but not limited to, any of GenBank Accession number(s) NP_001092266.1, NP_001092267.1, NP_001092268.1, and NP_116272.1. Other TOX2 polypeptides in human or other animal species can be identified and detected by one of ordinary skill in the art using techniques generally known to one of ordinary skill in the art.

As used herein, the abbreviation "HCP5" can refer to HLA Complex P5 gene, gene product, and/or protein. One of ordinary skill in the art will instantly appreciate RNA and protein variants, homologues, orthologues, and analogues of the HCP5 in humans and animals. For example, the HCP5 RNA can have a nucleotide sequence as specified by, but not limited to, any of GenBank Accession number(s) NR_040662.1.

As used herein, the abbreviation "RAC2" can refer to RAC2 high mobility group box family member 2 gene, gene product, and/or protein. One of ordinary skill in the art will instantly appreciate RNA and protein variants, homologues, orthologues, and analogues of the RAC2 in humans and animals. For example, the RAC2 mRNA can have a nucleotide sequence as specified by, but not limited to, any of GenBank Accession number(s) NM_002872.4. Other mRNA sequences that can be translated to form a RAC2 protein or variant thereof in human or other animal species can be identified and detected by one of ordinary skill in the art using techniques generally known to one of ordinary skill in the art. Similarly, RAC2 protein can have a polypeptide sequences as specified by, but not limited to, any of GenBank Accession number(s) NP_002863.1. Other RAC2 polypeptides in human or other animal species can be identified and detected by one of ordinary skill in the art using techniques generally known to one of ordinary skill in the art.

As used herein, the abbreviation "RGS1" can refer to Regulator of G-Protein Signaling 1 gene, gene product, and/or protein. One of ordinary skill in the art will instantly appreciate RNA and protein variants, homologues, orthologues, and analogues of the RGS1 in humans and animals. For example, the RGS1 mRNA can have a nucleotide sequence as specified by, but not limited to, any of GenBank Accession number(s) NM_002922.3. Other mRNA sequences that can be translated to form a RGS1 protein or variant thereof in human or other animal species can be identified and detected by one of ordinary skill in the art using techniques generally known to one of ordinary skill in the art. Similarly, RGS1 protein can have a polypeptide sequences as specified by, but not limited to, any of GenBank Accession number(s) NP_002913.3. Other RGS1 polypeptides in human or other animal species can be identified and detected by one of ordinary skill in the art using techniques generally known to one of ordinary skill in the art.

As used herein, the abbreviation "STAT4" can refer to Regulator of G-Protein Signaling 1 gene, gene product, and/or protein. One of ordinary skill in the art will instantly appreciate RNA and protein variants, homologues, orthologues, and analogues of the STAT4 in humans and animals. For example, the STAT4 mRNA can have a nucleotide sequence as specified by, but not limited to, any of GenBank Accession number(s) NM_001243835.1 and NM_003151.3. Other mRNA sequences that can be translated to form a STAT4 protein or variant thereof in human or other animal species can be identified and detected by one of ordinary skill in the art using techniques generally known to one of ordinary skill in the art. Similarly, STAT4 protein can have a polypeptide sequences as specified by, but not limited to, any of GenBank Accession number(s) NP_001230764.1 and NP_003142.1. Other STAT4 polypeptides in human or other animal species can be identified and detected by one of ordinary skill in the art using techniques generally known to one of ordinary skill in the art.

As used herein, the abbreviation "HLA-DMB" can refer to the Major Histocompatibility Complex, Class II, DM Beta gene, gene product, and/or protein. One of ordinary skill in the art will instantly appreciate RNA and protein variants, homologues, orthologues, and analogues of the HLA-DMB in humans and animals. For example, the HLA-DMB mRNA can have a nucleotide sequence as specified by, but not limited to, any of GenBank Accession number(s) NM_002118.4. Other mRNA sequences that can be translated to form a HLA-DMB protein or variant thereof in human or other animal species can be identified and detected by one of ordinary skill in the art using techniques generally known to one of ordinary skill in the art. Similarly, HLA-DMB protein can have a polypeptide sequences as specified by, but not limited to, any of GenBank Accession number(s) NP_002109.2. Other HLA-DMB polypeptides in human or other animal species can be identified and detected by one of ordinary skill in the art using techniques generally known to one of ordinary skill in the art.

As used herein, the abbreviation "NT5E" can refer to the 5'-Nucleotidase Ecto gene, gene product, and/or protein. One of ordinary skill in the art will instantly appreciate RNA and protein variants, homologues, orthologues, and analogues of the NT5E in humans and animals. For example, the NT5E mRNA can have a nucleotide sequence as specified by, but not limited to, any of GenBank Accession number(s) NM_001204813.1 and NM_002526.3. Other mRNA sequences that can be translated to form a NT5E protein or variant thereof in human or other animal species can be identified and detected by one of ordinary skill in the art using techniques generally known to one of ordinary skill in the art. Similarly, NT5E protein can have a polypeptide sequences as specified by, but not limited to, any of GenBank Accession number(s) NP_001191742.1 and NP_002517.1. Other NT5E polypeptides in human or other animal species can be identified and detected by one of ordinary skill in the art using techniques generally known to one of ordinary skill in the art.

As used herein, the abbreviation "BTG1" can refer to the B-Cell Translocation Gene 1 gene product, and/or protein. One of ordinary skill in the art will instantly appreciate RNA and protein variants, homologues, orthologues, and analogues of the BTG1 in humans and animals. For example, the BTG1 mRNA can have a nucleotide sequence as specified by, but not limited to, any of GenBank Accession number(s) NM_001731.2. Other mRNA sequences that can be translated to form a BTG1 protein or variant thereof in human or other animal species can be identified and detected by one of ordinary skill in the art using techniques generally known to one of ordinary skill in the art. Similarly, BTG1 protein can have a polypeptide sequences as specified by, but not limited to, any of GenBank Accession number(s) NP_001722.1. Other BTG1 polypeptides in human or other animal species can be identified and detected by one of ordinary skill in the art using techniques generally known to one of ordinary skill in the art.

As used herein, the abbreviation "CD14" can refer to the CD14 molecule gene, gene product, and/or protein. One of ordinary skill in the art will instantly appreciate RNA and protein variants, homologues, orthologues, and analogues of the CD14 in humans and animals. For example, the CD14 mRNA can have a nucleotide sequence as specified by, but not limited to, any of GenBank Accession number(s)

NM_000591.3. Other mRNA sequences that can be translated to form a CD14 protein or variant thereof in human or other animal species can be identified and detected by one of ordinary skill in the art using techniques generally known to one of ordinary skill in the art. Similarly, CD14 protein can have a polypeptide sequences as specified by, but not limited to, any of GenBank Accession number(s) NP_000582.1. Other CD14 polypeptides in human or other animal species can be identified and detected by one of ordinary skill in the art using techniques generally known to one of ordinary skill in the art As used herein, the abbreviation "F13A1" can refer to the Coagulation Factor XIII A Chain gene, gene product, and/or protein. One of ordinary skill in the art will instantly appreciate RNA and protein variants, homologues, orthologues, and analogues of the F13A1 in humans and animals. For example, the F13A1 mRNA can have a nucleotide sequence as specified by, but not limited to, any of GenBank Accession number(s) NM_000129.3. Other mRNA sequences that can be translated to form a F13A1 protein or variant thereof in human or other animal species can be identified and detected by one of ordinary skill in the art using techniques generally known to one of ordinary skill in the art. Similarly, F13A1 protein can have a polypeptide sequences as specified by, but not limited to, any of GenBank Accession number(s) NP_000120.2. Other F13A1 polypeptides in human or other animal species can be identified and detected by one of ordinary skill in the art using techniques generally known to one of ordinary skill in the art.

As used herein, the abbreviation "FGL2" can refer to the fibrinogen like 2 gene, gene product, and/or protein. One of ordinary skill in the art will instantly appreciate RNA and protein variants, homologues, orthologues, and analogues of the FGL2 in humans and animals. For example, the FGL2 mRNA can have a nucleotide sequence as specified by, but not limited to, any of GenBank Accession number(s) NM_006682.2. Other mRNA sequences that can be translated to form a FGL2 protein or variant thereof in human or other animal species can be identified and detected by one of ordinary skill in the art using techniques generally known to one of ordinary skill in the art. Similarly, FGL2 protein can have a polypeptide sequences as specified by, but not limited to, any of GenBank Accession number(s) NP_006673.1. Other FGL2 polypeptides in human or other animal species can be identified and detected by one of ordinary skill in the art using techniques generally known to one of ordinary skill in the art.

As used herein, the abbreviation "FOLR3" can refer to the Folate Receptor 3 (Gamma) gene, gene product, and/or protein. One of ordinary skill in the art will instantly appreciate RNA and protein variants, homologues, orthologues, and analogues of the FOLR3 in humans and animals. For example, the FOLR3 mRNA can have a nucleotide sequence as specified by, but not limited to, any of GenBank Accession number(s) NM_000804.3. Other mRNA sequences that can be translated to form a FOLR3 protein or variant thereof in human or other animal species can be identified and detected by one of ordinary skill in the art using techniques generally known to one of ordinary skill in the art. Similarly, FOLR3 protein can have a polypeptide sequences as specified by, but not limited to, any of GenBank Accession number(s) NP_000795.2. Other FOLR3 polypeptides in human or other animal species can be identified and detected by one of ordinary skill in the art using techniques generally known to one of ordinary skill in the art.

As used herein, the abbreviation "MX1" can refer to the MX Dynamin like GTPase 1 gene, gene product, and/or protein. One of ordinary skill in the art will instantly appreciate RNA and protein variants, homologues, orthologues, and analogues of the MX1 in humans and animals. For example, the MX1 mRNA can have a nucleotide sequence as specified by, but not limited to, any of GenBank Accession number(s) NM_001144925.2. Other mRNA sequences that can be translated to form a MX1 protein or variant thereof in human or other animal species can be identified and detected by one of ordinary skill in the art using techniques generally known to one of ordinary skill in the art. Similarly, MX1 protein can have a polypeptide sequences as specified by, but not limited to, any of GenBank Accession number(s) NP_001138397.1. Other MX1 polypeptides in human or other animal species can be identified and detected by one of ordinary skill in the art using techniques generally known to one of ordinary skill in the art.

As used herein, the abbreviation "PSENEN" can refer to the Presenilin Enhancer Gamma Secretase Subunit gene, gene product, and/or protein. One of ordinary skill in the art will instantly appreciate RNA and protein variants, homologues, orthologues, and analogues of the PSENEN in humans and animals. For example, the RPSENEN mRNA can have a nucleotide sequence as specified by, but not limited to, any of GenBank Accession number(s) NM_172341.2. Other mRNA sequences that can be translated to form a RSENEN protein or variant thereof in human or other animal species can be identified and detected by one of ordinary skill in the art using techniques generally known to one of ordinary skill in the art. Similarly, PSENEN protein can have a polypeptide sequences as specified by, but not limited to, any of GenBank Accession number(s) NP_758844.1. Other PSENEN polypeptides in human or other animal species can be identified and detected by one of ordinary skill in the art using techniques generally known to one of ordinary skill in the art.

As used herein, the abbreviation "IFI6" can refer to the Interferon Alpha Inducible Protein 6 gene, gene product, and/or protein. One of ordinary skill in the art will instantly appreciate RNA and protein variants, homologues, orthologues, and analogues of the IFI6 in humans and animals. For example, the IFI6 mRNA can have a nucleotide sequence as specified by, but not limited to, any of GenBank Accession number(s) NM_002038.3. Other mRNA sequences that can be translated to form an IFI6 protein or variant thereof in human or other animal species can be identified and detected by one of ordinary skill in the art using techniques generally known to one of ordinary skill in the art. Similarly, IFI6 protein can have a polypeptide sequences as specified by, but not limited to, any of GenBank Accession number(s) NP_002029.3. Other IFI6 polypeptides in human or other animal species can be identified and detected by one of ordinary skill in the art using techniques generally known to one of ordinary skill in the art.

As used herein, the abbreviation "HS3ST2" can refer to the Heparan Sulfate-Glucosamine 3-Sulfotransferase 2 gene, gene product, and/or protein. One of ordinary skill in the art will instantly appreciate RNA and protein variants, homologues, orthologues, and analogues of the HS3ST2 in humans and animals. For example, the HS3ST2 mRNA can have a nucleotide sequence as specified by, but not limited to, any of GenBank Accession number(s) NM_006043.1. Other mRNA sequences that can be translated to form a HS3ST2 protein or variant thereof in human or other animal species can be identified and detected by one of ordinary skill in the art using techniques generally known to one of ordinary skill in the art. Similarly, HS3ST2 protein can have a polypeptide sequences as specified by, but not limited to, any of GenBank Accession number(s NP_006034.1. Other HS3ST2 polypeptides in human or other animal species can be identified and detected by one of ordinary skill in the art using techniques generally known to one of ordinary skill in the art.

As used herein, the abbreviation "TAGLN3" can refer to the Transgelin 3 gene, gene product, and/or protein. One of ordinary skill in the art will instantly appreciate RNA and protein variants, homologues, orthologues, and analogues of the TAGLN3 in humans and animals. For example, the TAGLN3 mRNA can have a nucleotide sequence as specified by, but not limited to, any of GenBank Accession number(s) NM_013259.2. Other mRNA sequences that can be translated to form a TAGLN3 protein or variant thereof in human or other animal species can be identified and detected by one of ordinary skill in the art using techniques generally known to one of ordinary skill in the art. Similarly, TAGLN3 protein can have a polypeptide sequences as specified by, but not limited to, any of GenBank Accession numbers NP_037391.2. Other TAGLN3 polypeptides in human or other animal species can be identified and detected by one of ordinary skill in the art using techniques generally known to one of ordinary skill in the art.

As used herein, the abbreviation "SV2B" can refer to the Synaptic Vesicle Glycoprotein 2B gene, gene product, and/or protein. One of ordinary skill in the art will instantly appreciate RNA and protein variants, homologues, orthologues, and analogues of the SV2B in humans and animals. For example, the SV2B mRNA can have a nucleotide sequence as specified by, but not limited to, any of GenBank Accession number(s) and NM_014848.6. Other mRNA sequences that can be translated to form a SV2B protein or variant thereof in human or other animal species can be identified and detected by one of ordinary skill in the art using techniques generally known to one of ordinary skill in the art. Similarly, SV2B protein can have a polypeptide sequences as specified by, but not limited to, any of GenBank Accession number(s) NP_055663.1. Other SV2B polypeptides in human or other animal species can be identified and detected by one of ordinary skill in the art using techniques generally known to one of ordinary skill in the art.

As used herein, the abbreviation "NCALD" can refer to the Neurocalcin Delta gene, gene product, and/or protein. One of ordinary skill in the art will instantly appreciate RNA and protein variants, homologues, orthologues, and analogues of the NCALD in humans and animals. For example, the NCALD mRNA can have a nucleotide sequence as specified by, but not limited to, any of GenBank Accession number(s) NM_001040624.1. Other mRNA sequences that can be translated to form a NCALD protein or variant thereof in human or other animal species can be identified and detected by one of ordinary skill in the art using techniques generally known to one of ordinary skill in the art. Similarly, NCALD protein can have a polypeptide sequences as specified by, but not limited to, any of GenBank Accession number(s) NP_001035714.1. Other NCALD polypeptides in human or other animal species can be identified and detected by one of ordinary skill in the art using techniques generally known to one of ordinary skill in the art.

As used herein, the abbreviation "ENC1" can refer to the Ectodermal-Neural Cortex 1 gene, gene product, and/or protein. One of ordinary skill in the art will instantly appreciate RNA and protein variants, homologues, orthologues, and analogues of the ENC1 in humans and animals. For example, the ENC1 mRNA can have a nucleotide sequence as specified by, but not limited to, any of GenBank Accession numbers NM_003633.3. Other mRNA sequences that can be translated to form an ENC1 protein or variant thereof in human or other animal species can be identified and detected by one of ordinary skill in the art using techniques generally known to one of ordinary skill in the art. Similarly, ENC1 protein can have a polypeptide sequences as specified by, but not limited to, any of GenBank Accession number(s) NP_003624.1. Other ENC1 polypeptides in human or other animal species can be identified and detected by one of ordinary skill in the art using techniques generally known to one of ordinary skill in the art.

As used herein, the abbreviation "COBL" can refer to the Cordon-Bleu WH2 Repeat Protein gene, gene product, and/or protein. One of ordinary skill in the art will instantly appreciate RNA and protein variants, homologues, orthologues, and analogues of the COBL in humans and animals. For example, the COBL mRNA can have a nucleotide sequence as specified by, but not limited to, any of GenBank Accession number(s) NM_001287436.1. Other mRNA sequences that can be translated to form a COBL protein or variant thereof in human or other animal species can be identified and detected by one of ordinary skill in the art using techniques generally known to one of ordinary skill in the art. Similarly, COBL protein can have a polypeptide sequences as specified by, but not limited to, any of GenBank Accession number(s) NP_001274365.1. Other COBL polypeptides in human or other animal species can be identified and detected by one of ordinary skill in the art using techniques generally known to one of ordinary skill in the art.

As used herein, the abbreviation "EEF1A2" can refer to the Eukaryotic Translation Elongation Factor 1 Alpha 2 gene, gene product, and/or protein. One of ordinary skill in the art will instantly appreciate RNA and protein variants, homologues, orthologues, and analogues of the EEF1A2 in humans and animals. For example, the EEF1A2 mRNA can have a nucleotide sequence as specified by, but not limited to, any of GenBank Accession number(s) NM_001958.3. Other mRNA sequences that can be translated to form an EEF1A2 protein or variant thereof in human or other animal species can be identified and detected by one of ordinary skill in the art using techniques generally known to one of ordinary skill in the art. Similarly, EEF1A2 protein can have a polypeptide sequences as specified by, but not limited to, any of GenBank Accession number(s) NP_001949.1. Other EEF1A2 polypeptides in human or other animal species can be identified and detected by one of ordinary skill in the art using techniques generally known to one of ordinary skill in the art.

As used herein, the abbreviation "KBTBD11" can refer to the Kelch Repeat and BTB Domain Containing 11 gene, gene product, and/or protein. One of ordinary skill in the art will instantly appreciate RNA and protein variants, homologues, orthologues, and analogues of the KBTBD11 in humans and animals. For example, the KBTBD11 mRNA can have a nucleotide sequence as specified by, but not limited to, any of GenBank Accession number(s) NM_001958.3. Other mRNA sequences that can be translated to form a KBTBD11 protein or variant thereof in human or other animal species can be identified and detected by one of ordinary skill in the art using techniques generally known to one of ordinary skill in the art. Similarly, KBTBD11 protein can have a polypeptide sequences as specified by, but not limited to, any of GenBank Accession number(s) NP_055682.1. Other KBTBD11 polypeptides in human or other animal species can be identified and detected by one of ordinary skill in the art using techniques generally known to one of ordinary skill in the art.

As used herein, the abbreviation "RGL1" can refer to the Ral Guanine Nucleotide Dissociation Stimulator Like 1 gene, gene product, and/or protein. One of ordinary skill in the art will instantly appreciate RNA and protein variants, homologues, orthologues, and analogues of the RGL1 in humans and animals. For example, the RGL1 mRNA can have a nucleotide sequence as specified by, but not limited to, any of GenBank Accession number(s) NM_015149.4. Other mRNA sequences that can be translated to form a RGL1 protein or variant thereof in human or other animal species can be identified and detected by one of ordinary skill in the art using techniques generally known to one of ordinary skill in the art. Similarly, RGL1 protein can have a polypeptide sequences as specified by, but not limited to, any of GenBank Accession number(s) NP_055964.3. Other RGL1 polypeptides in human or other animal species can be identified and detected by one of ordinary skill in the art using techniques generally known to one of ordinary skill in the art.

As used herein, the abbreviation "CA11" can refer to the Carbonic Anhydrase 11 gene, gene product, and/or protein. One of ordinary skill in the art will instantly appreciate RNA and protein variants, homologues, orthologues, and analogues of the CA11 in humans and animals. For example, the CA11 mRNA can have a nucleotide sequence as specified by, but not limited to, any of GenBank Accession number(s) NM_001217.4. Other mRNA sequences that can be translated to form a CA11 protein or variant thereof in human or other animal species can be identified and detected by one of ordinary skill in the art using techniques generally known to one of ordinary skill in the art. Similarly, CA11 protein can have a polypeptide sequences as specified by, but not limited to, any of GenBank Accession number(s) NP_001208.2. Other CA11 polypeptides in human or other animal species can be identified and detected by one of ordinary skill in the art using techniques generally known to one of ordinary skill in the art.

As used herein, the abbreviation "NETO2" can refer to the Neuropilin and Tolloid Like 2 gene, gene product, and/or protein. One of ordinary skill in the art will instantly appreciate RNA and protein variants, homologues, orthologues, and analogues of the NETO2 in humans and animals. For example, the NETO2 mRNA can have a nucleotide sequence as specified by, but not limited to, any of GenBank Accession number(s) NM_018092.4. Other mRNA sequences that can be translated to form a NETO2 protein or variant thereof in human or other animal species can be identified and detected by one of ordinary skill in the art using techniques generally known to one of ordinary skill in the art. Similarly, NETO2 protein can have a polypeptide sequences as specified by, but not limited to, any of GenBank Accession number(s) NP_060562.3. Other NETO2 polypeptides in human or other animal species can be identified and detected by one of ordinary skill in the art using techniques generally known to one of ordinary skill in the art.

As used herein, the abbreviation "DOK5" can refer to the Docking Protein 5 gene, gene product, and/or protein. One of ordinary skill in the art will instantly appreciate RNA and protein variants, homologues, orthologues, and analogues of the DOK5 in humans and animals. For example, the DOK5 mRNA can have a nucleotide sequence as specified by, but not limited to, any of GenBank Accession number(s) NM_018431.4. Other mRNA sequences that can be translated to form a DOK5 protein or variant thereof in human or other animal species can be identified and detected by one of ordinary skill in the art using techniques generally known to one of ordinary skill in the art. Similarly, DOK5 protein can have a polypeptide sequences as specified by, but not limited to, any of GenBank Accession number(s) NP_060901.2. Other DOK5 polypeptides in human or other animal species can be identified and detected by one of ordinary skill in the art using techniques generally known to one of ordinary skill in the art.

As used herein, the abbreviation "TUBB2B" can refer to the Tubulin Beta 2B Class IIb gene, gene product, and/or protein. One of ordinary skill in the art will instantly appreciate RNA and protein variants, homologues, orthologues, and analogues of the TUBB2B in humans and animals. For example, the TUBB2B mRNA can have a nucleotide sequence as specified by, but not limited to, any of GenBank Accession number(s) NM_178012.4. Other mRNA sequences that can be translated to form a TUBB2B protein or variant thereof in human or other animal species can be identified and detected by one of ordinary skill in the art using techniques generally known to one of ordinary skill in the art. Similarly, TUBB2B protein can have a polypeptide sequences as specified by, but not limited to, any of GenBank Accession number(s) NP_821080.1. Other TUBB2B polypeptides in human or other animal species can be identified and detected by one of ordinary skill in the art using techniques generally known to one of ordinary skill in the art.

As used herein, the abbreviation "PCDH19" can refer to the Protocadherin 19, gene, gene product, and/or protein. One of ordinary skill in the art will instantly appreciate RNA and protein variants, homologues, orthologues, and analogues of the PCDH19 in humans and animals. For example, the PCDH19 mRNA can have a nucleotide sequence as specified by, but not limited to, any of GenBank Accession number(s) NM_001105243.1. Other mRNA sequences that can be translated to form a PCDH19 protein or variant thereof in human or other animal species can be identified and detected by one of ordinary skill in the art using techniques generally known to one of ordinary skill in the art. Similarly, PCDH19 protein can have a polypeptide sequences as specified by, but not limited to, any of GenBank Accession number(s) NP_001098713.1. Other PCDH19 polypeptides in human or other animal species can be identified and detected by one of ordinary skill in the art using techniques generally known to one of ordinary skill in the art.

As used herein, the abbreviation "PTPRO" can refer to the Protein Tyrosine Phosphatase, Receptor Type O gene, gene product, and/or protein. One of ordinary skill in the art will instantly appreciate RNA and protein variants, homologues, orthologues, and analogues of the PTPRO in humans and animals. For example, the PTPRO mRNA can have a nucleotide sequence as specified by, but not limited to, any of GenBank Accession number(s) NM_030667.2. Other mRNA sequences that can be translated to form a PTPRO protein or variant thereof in human or other animal species can be identified and detected by one of ordinary skill in the art using techniques generally known to one of ordinary skill in the art. Similarly, PTPRO protein can have a polypeptide sequences as specified by, but not limited to, any of GenBank Accession number(s) NP_109592.1. Other PTPRO polypeptides in human or other animal species can be identified and detected by one of ordinary skill in the art using techniques generally known to one of ordinary skill in the art.

As used herein, the abbreviation "SATB2" can refer to the SATB Homeobox 2 gene, gene product, and/or protein. One of ordinary skill in the art will instantly appreciate RNA and protein variants, homologues, orthologues, and analogues of the SATB2 in humans and animals. For example, the SATB2 mRNA can have a nucleotide sequence as specified by, but not limited to, any of GenBank Accession number(s) NM_001172509.1. Other mRNA sequences that can be translated to form a SATB2 protein or variant thereof in human or other animal species can be identified and detected by one of ordinary skill in the art using techniques generally known to one of ordinary skill in the art. Similarly, SATB2 protein can have a polypeptide sequences as specified by, but not limited to, any of GenBank Accession number(s) NP_001165980.1. Other SATB2 polypeptides in human or other animal species can be identified and detected by one of ordinary skill in the art using techniques generally known to one of ordinary skill in the art.

As used herein, the abbreviation "FGF13" can refer to the Fibroblast Growth Factor 13 gene, gene product, and/or protein. One of ordinary skill in the art will instantly appreciate RNA and protein variants, homologues, orthologues, and analogues of the FGF13 in humans and animals. For example, the FGF13 mRNA can have a nucleotide sequence as specified by, but not limited to, any of GenBank Accession number(s) NM_004114.3. Other mRNA sequences that can be translated to form a FGF13 protein or variant thereof in human or other animal species can be identified and detected by one of ordinary skill in the art using techniques generally known to one of ordinary skill in the art. Similarly, FGF13 protein can have a polypeptide sequences as specified by, but not limited to, any of GenBank Accession number(s) NP_004105.1. Other FGF13 polypeptides in human or other animal species can be identified and detected by one of ordinary skill in the art using techniques generally known to one of ordinary skill in the art.

As used herein, the abbreviation "CXADR" can refer to the Coxsackie Virus And Adenovirus Receptor gene, gene product, and/or protein. One of ordinary skill in the art will instantly appreciate RNA and protein variants, homologues, orthologues, and analogues of the CXADR in humans and animals. For example, the CXADR mRNA can have a nucleotide sequence as specified by, but not limited to, any of GenBank Accession number(s) NM_001338.4. Other mRNA sequences that can be translated to form a CXADR protein or variant thereof in human or other animal species can be identified and detected by one of ordinary skill in the art using techniques generally known to one of ordinary skill in the art. Similarly, CXADR protein can have a polypeptide sequences as specified by, but not limited to, any of GenBank Accession number(s) NP_001329.1. Other CXADR polypeptides in human or other animal species can be identified and detected by one of ordinary skill in the art using techniques generally known to one of ordinary skill in the art.

As used herein, the abbreviation "MLLT11" can refer to the Myeloid/Lymphoid or Mixed-Lineage Leukemia; Translocated To, 11 gene, gene product, and/or protein. One of ordinary skill in the art will instantly appreciate RNA and protein variants, homologues, orthologues, and analogues of the MLLT11 in humans and animals. For example, the MLLT11 mRNA can have a nucleotide sequence as specified by, but not limited to, any of GenBank Accession number(s) NM_006818.3. Other mRNA sequences that can be translated to form a MLLT11 protein or variant thereof in human or other animal species can be identified and detected by one of ordinary skill in the art using techniques generally known to one of ordinary skill in the art. Similarly, MLLT11 protein can have a polypeptide sequences as specified by, but not limited to, any of GenBank Accession number(s) NP_006809.1. Other MLLT11 polypeptides in human or other animal species can be identified and detected by one of ordinary skill in the art using techniques generally known to one of ordinary skill in the art.

As used herein, the abbreviation "TMEFF2" can refer to the Transmembrane Protein with EGF Like and Two Follistatin like Domains 2 gene, gene product, and/or protein. One of ordinary skill in the art will instantly appreciate RNA and protein variants, homologues, orthologues, and analogues of the TMEFF2 in humans and animals. For example, the TMEFF2 mRNA can have a nucleotide sequence as specified by, but not limited to, any of GenBank Accession number(s) NM_016192.3. Other mRNA sequences that can be translated to form a TMEFF2 protein or variant thereof in human or other animal species can be identified and detected by one of ordinary skill in the art using techniques generally known to one of ordinary skill in the art. Similarly, TMEFF2 protein can have a polypeptide sequences as specified by, but not limited to, any of GenBank Accession number(s) NP_057276.2. Other TMEFF2 polypeptides in human or other animal species can be identified and detected by one of ordinary skill in the art using techniques generally known to one of ordinary skill in the art.

As used herein, the abbreviation "BRSK1" can refer to the BR Serine/Threonine Kinase 1 gene, gene product, and/or protein. One of ordinary skill in the art will instantly appreciate RNA and protein variants, homologues, orthologues, and analogues of the BRSK1 in humans and animals. For example, the BRSK1 mRNA can have a nucleotide sequence as specified by, but not limited to, any of GenBank Accession number(s) NM_032430.1. Other mRNA sequences that can be translated to form a BRSK1 protein or variant thereof in human or other animal species can be identified and detected by one of ordinary skill in the art using techniques generally known to one of ordinary skill in the art. Similarly, BRSK1 protein can have a polypeptide sequences as specified by, but not limited to, any of GenBank Accession number(s) NP_115806.1. Other BRSK1 polypeptides in human or other animal species can be identified and detected by one of ordinary skill in the art using techniques generally known to one of ordinary skill in the art.

As used herein, the abbreviation "NRGN" can refer to the Neurogranin gene, gene product, and/or protein. One of ordinary skill in the art will instantly appreciate RNA and protein variants, homologues, orthologues, and analogues of the NRGN in humans and animals. For example, the NRGN mRNA can have a nucleotide sequence as specified by, but not limited to, any of GenBank Accession number(s) NM_006176.2. Other mRNA sequences that can be translated to form a NRGN protein or variant thereof in human or other animal species can be identified and detected by one of ordinary skill in the art using techniques generally known to one of ordinary skill in the art. Similarly, NRGN protein can have a polypeptide sequences as specified by, but not limited to, any of GenBank Accession number(s) NP_006167.1. Other NRGN polypeptides in human or other animal species can be identified and detected by one of ordinary skill in the art using techniques generally known to one of ordinary skill in the art.

As used herein, the abbreviation "TAC1" can refer to the Tachykinin Precursor 1 gene, gene product, and/or protein. One of ordinary skill in the art will instantly appreciate RNA and protein variants, homologues, orthologues, and analogues of the TAC1 in humans and animals. For example, the TAC1 mRNA can have a nucleotide sequence as specified by, but not limited to, any of GenBank Accession number(s) NM_003182.2. Other mRNA sequences that can be translated to form a TAC1 protein or variant thereof in human or other animal species can be identified and detected by one of ordinary skill in the art using techniques generally known to one of ordinary skill in the art. Similarly, TAC1 protein can have a polypeptide sequences as specified by, but not limited to, any of GenBank Accession number(s) NP_003173.1. Other TAC1 polypeptides in human or other animal species can be identified and detected by one of ordinary skill in the art using techniques generally known to one of ordinary skill in the art.

As used herein, the abbreviation "CDH10" can refer to the Cadherin 10 gene, gene product, and/or protein. One of ordinary skill in the art will instantly appreciate RNA and protein variants, homologues, orthologues, and analogues of the CDH10 in humans and animals. For example, the CDH10 mRNA can have a nucleotide sequence as specified by, but not limited to, any of GenBank Accession number(s) NM_006727.4. Other mRNA sequences that can be translated to form a CDH10 protein or variant thereof in human or other animal species can be identified and detected by one of ordinary skill in the art using techniques generally known to one of ordinary skill in the art. Similarly, CDH10 protein can have a polypeptide sequences as specified by, but not limited to, any of GenBank Accession number(s) NP_006718.2. Other CDH10 polypeptides in human or other animal species can be identified and detected by one of ordinary skill in the art using techniques generally known to one of ordinary skill in the art.

As used herein, the abbreviation "TPD52L1" can refer to the Tumor Protein D52-Like 1 gene, gene product, and/or protein. One of ordinary skill in the art will instantly appreciate RNA and protein variants, homologues, orthologues, and analogues of the TPD52L1 in humans and animals. For example, the TPD52L1 mRNA can have a nucleotide sequence as specified by, but not limited to, any of GenBank Accession number(s) NM_003287.3. Other mRNA sequences that can be translated to form a TPD52L1 protein or variant thereof in human or other animal species can be identified and detected by one of ordinary skill in the art using techniques generally known to one of ordinary skill in the art. Similarly, TPD52L1 protein can have a polypeptide sequences as specified by, but not limited to, any of GenBank Accession number(s) NP_003278.1. Other TPD52L1 polypeptides in human or other animal species can be identified and detected by one of ordinary skill in the art using techniques generally known to one of ordinary skill in the art.

As used herein, the abbreviation "HIST2H2BE" can refer to the Histone Cluster 2, H2be gene, gene product, and/or protein. One of ordinary skill in the art will instantly appreciate RNA and protein variants, homologues, orthologues, and analogues of the HIST2H2BE in humans and animals. For example, the HIST2H2BE mRNA can have a nucleotide sequence as specified by, but not limited to, any of GenBank Accession number(s) NM_003528.2. Other mRNA sequences that can be translated to form a HIST2H2BE protein or variant thereof in human or other animal species can be identified and detected by one of ordinary skill in the art using techniques generally known to one of ordinary skill in the art. Similarly, HIST2H2BE protein can have a polypeptide sequences as specified by, but not limited to, any of GenBank Accession number(s) NP_003519.1. Other HIST2H2BE polypeptides in human or other animal species can be identified and detected by one of ordinary skill in the art using techniques generally known to one of ordinary skill in the art.

As used herein, the abbreviation "SLC16A9" can refer to the Solute Carrier Family 16 Member 9 gene, gene product, and/or protein. One of ordinary skill in the art will instantly appreciate RNA and protein variants, homologues, orthologues, and analogues of the SLC16A9 in humans and animals. For example, the SLC16A9 mRNA can have a nucleotide sequence as specified by, but not limited to, any of GenBank Accession number(s) NM_194298.2. Other mRNA sequences that can be translated to form a SLC16A9 protein or variant thereof in human or other animal species can be identified and detected by one of ordinary skill in the art using techniques generally known to one of ordinary skill in the art. Similarly, SLC16A9 protein can have a polypeptide sequences as specified by, but not limited to, any of GenBank Accession number(s) NP_919274.1. Other SLC16A9 polypeptides in human or other animal species can be identified and detected by one of ordinary skill in the art using techniques generally known to one of ordinary skill in the art.

As used herein, the abbreviation "MEGF10" can refer to the Multiple EGF Like Domains 10 gene, gene product, and/or protein. One of ordinary skill in the art will instantly appreciate RNA and protein variants, homologues, orthologues, and analogues of the MEGF10 in humans and animals. For example, the MEGF10 mRNA can have a nucleotide sequence as specified by, but not limited to, any of GenBank Accession number(s) NM_032446.2. Other mRNA sequences that can be translated to form a MEGF10 protein or variant thereof in human or other animal species can be identified and detected by one of ordinary skill in the art using techniques generally known to one of ordinary skill in the art. Similarly, MEGF10 protein can have a polypeptide sequences as specified by, but not limited to, any of GenBank Accession number(s) NP_115822.1. Other MEGF10 polypeptides in human or other animal species can be identified and detected by one of ordinary skill in the art using techniques generally known to one of ordinary skill in the art.

As used herein, the abbreviation "FMNL2" can refer to the Formin like 2 gene, gene product, and/or protein. One of ordinary skill in the art will instantly appreciate RNA and protein variants, homologues, orthologues, and analogues of the FMNL2 in humans and animals. For example, the FMNL2 mRNA can have a nucleotide sequence as specified by, but not limited to, any of GenBank Accession number(s) NM_052905.3. Other mRNA sequences that can be translated to form a FMNL2 protein or variant thereof in human or other animal species can be identified and detected by one of ordinary skill in the art using techniques generally known to one of ordinary skill in the art. Similarly, FMNL2 protein can have a polypeptide sequences as specified by, but not limited to, any of GenBank Accession number(s) NP_443137.2. Other FMNL2 polypeptides in human or other animal species can be identified and detected by one of ordinary skill in the art using techniques generally known to one of ordinary skill in the art.

As used herein, the abbreviation "KIAA1598" can refer to the Shootin 1 gene, gene product, and/or protein. One of ordinary skill in the art will instantly appreciate RNA and protein variants, homologues, orthologues, and analogues of the KIAA1598 in humans and animals. For example, the KIAA1598 mRNA can have a nucleotide sequence as specified by, but not limited to, any of GenBank Accession number(s) NM_001127211.2. Other mRNA sequences that can be translated to form a KIAA1598 protein or variant thereof in human or other animal species can be identified and detected by one of ordinary skill in the art using techniques generally known to one of ordinary skill in the art. Similarly, KIAA1598 protein can have a polypeptide sequences as specified by, but not limited to, any of GenBank Accession number(s) NP_001120683.1. Other KIAA1598 polypeptides in human or other animal species can be identified and detected by one of ordinary skill in the art using techniques generally known to one of ordinary skill in the art.

As used herein, the abbreviation "DNER" can refer to the Delta/Notch Like EGF Repeat Containing gene, gene product, and/or protein. One of ordinary skill in the art will instantly appreciate RNA and protein variants, homologues, orthologues, and analogues of the DNER in humans and animals. For example, the DNER mRNA can have a nucleotide sequence as specified by, but not limited to, any of GenBank Accession number(s) NM_139072.3. Other mRNA sequences that can be translated to form a DNER protein or variant thereof in human or other animal species can be identified and detected by one of ordinary skill in the art using techniques generally known to one of ordinary skill in the art. Similarly, DNER protein can have a polypeptide sequences as specified by, but not limited to, any of GenBank Accession number(s) NP_620711.3. Other DNER polypeptides in human or other animal species can be identified and detected by one of ordinary skill in the art using techniques generally known to one of ordinary skill in the art.

As used herein, the abbreviation "KAL1" can refer to the Anosmin 1 gene, gene product, and/or protein. One of ordinary skill in the art will instantly appreciate RNA and protein variants, homologues, orthologues, and analogues of the KAL1 in humans and animals. For example, the KAL1 mRNA can have a nucleotide sequence as specified by, but not limited to, any of GenBank Accession number(s) NM_000216.3. Other mRNA sequences that can be translated to form a KAL1 protein or variant thereof in human or other animal species can be identified and detected by one of ordinary skill in the art using techniques generally known to one of ordinary skill in the art. Similarly, KAL1 protein can have a polypeptide sequences as specified by, but not limited to, any of GenBank Accession number(s) NP_000207.2. Other KAL1 polypeptides in human or other animal species can be identified and detected by one of ordinary skill in the art using techniques generally known to one of ordinary skill in the art.

As used herein, the abbreviation "CD45" can refer to the Protein Tyrosine Phosphatase, Receptor Type C gene, gene product, and/or protein. One of ordinary skill in the art will instantly appreciate RNA and protein variants, homologues, orthologues, and analogues of the CD45 in humans and animals. For example, the CD45 mRNA can have a nucleotide sequence as specified by, but not limited to, any of GenBank Accession number(s) NM_002838.4. Other mRNA sequences that can be translated to form a CD45 protein or variant thereof in human or other animal species can be identified and detected by one of ordinary skill in the art using techniques generally known to one of ordinary skill in the art. Similarly, CD45 protein can have a polypeptide sequences as specified by, but not limited to, any of GenBank Accession number(s) NP_002829.3. Other CD45 polypeptides in human or other animal species can be identified and detected by one of ordinary skill in the art using techniques generally known to one of ordinary skill in the art.

As used herein, the abbreviation "AMY1C" can refer to the Amylase, Alpha 1C (Salivary) gene, gene product, and/or protein. One of ordinary skill in the art will instantly appreciate RNA and protein variants, homologues, orthologues, and analogues of the AMY1C in humans and animals. For example, the AMY1C mRNA can have a nucleotide sequence as specified by, but not limited to, any of GenBank Accession number(s) NM_001008219.1. Other mRNA sequences that can be translated to form an AMY1C protein or variant thereof in human or other animal species can be identified and detected by one of ordinary skill in the art using techniques generally known to one of ordinary skill in the art. Similarly, AMY1C protein can have a polypeptide sequences as specified by, but not limited to, any of GenBank Accession number(s) NP_001008220.1. Other AMY1C polypeptides in human or other animal species can be identified and detected by one of ordinary skill in the art using techniques generally known to one of ordinary skill in the art.

As used herein, the abbreviation "AMY1A" can refer to the Amylase, Alpha 1A (Salivary) gene, gene product, and/or protein. One of ordinary skill in the art will instantly appreciate RNA and protein variants, homologues, orthologues, and analogues of the AMY1A in humans and animals. For example, the AMY1A mRNA can have a nucleotide sequence as specified by, but not limited to, any of GenBank Accession number(s) NM_004038.3. Other mRNA sequences that can be translated to form an AMY1A protein or variant thereof in human or other animal species can be identified and detected by one of ordinary skill in the art using techniques generally known to one of ordinary skill in the art. Similarly, AMY1A protein can have a polypeptide sequences as specified by, but not limited to, any of GenBank Accession number(s) NP_004029.2. Other AMY1A polypeptides in human or other animal species can be identified and detected by one of ordinary skill in the art using techniques generally known to one of ordinary skill in the art.

As used herein, the abbreviation "GCG" can refer to the glucagon gene, gene product, and/or protein. One of ordinary skill in the art will instantly appreciate RNA and protein variants, homologues, orthologues, and analogues of the GCG in humans and animals. For example, the GCG mRNA can have a nucleotide sequence as specified by, but not limited to, any of GenBank Accession number(s) NM_002054.4. Other mRNA sequences that can be translated to form a GCG protein or variant thereof in human or other animal species can be identified and detected by one of ordinary skill in the art using techniques generally known to one of ordinary skill in the art. Similarly, GCG protein can have a polypeptide sequences as specified by, but not limited to, any of GenBank Accession number(s) NP_002045.1. Other GCG polypeptides in human or other animal species can be identified and detected by one of ordinary skill in the art using techniques generally known to one of ordinary skill in the art.

As used herein, the abbreviation "CEBPD" can refer to the CCAAT/Enhancer Binding Protein Delta gene, gene product, and/or protein. One of ordinary skill in the art will instantly appreciate RNA and protein variants, homologues, orthologues, and analogues of the CEBPD in humans and animals. For example, the CEBPD mRNA can have a nucleotide sequence as specified by, but not limited to, any of GenBank Accession number(s) NM_005195.3. Other mRNA sequences that can be translated to form a CEBPD protein or variant thereof in human or other animal species can be identified and detected by one of ordinary skill in the art using techniques generally known to one of ordinary skill in the art. Similarly, CEBPD protein can have a polypeptide sequences as specified by, but not limited to, any of GenBank Accession number(s) NP_005186.2. Other CEBPD polypeptides in human or other animal species can be identified and detected by one of ordinary skill in the art using techniques generally known to one of ordinary skill in the art.

As used herein, the abbreviation "CEBPD" can refer to the CCAAT/Enhancer Binding Protein Delta gene, gene product, and/or protein. One of ordinary skill in the art will instantly appreciate RNA and protein variants, homologues, orthologues, and analogues of the CEBPD in humans and animals. For example, the CEBPD mRNA can have a nucleotide sequence as specified by, but not limited to, any of GenBank Accession number(s) NM_005195.3. Other mRNA sequences that can be translated to form a CEBPD protein or variant thereof in human or other animal species can be identified and detected by one of ordinary skill in the art using techniques generally known to one of ordinary skill in the art. Similarly, CEBPD protein can have a polypeptide sequences as specified by, but not limited to, any of GenBank Accession number(s) NP_005186.2. Other CEBPD polypeptides in human or other animal species can be identified and detected by one of ordinary skill in the art using techniques generally known to one of ordinary skill in the art.

As used herein, the abbreviation "STEAP3" can refer to the Six-Transmembrane Epithelial Antigen of Prostate 3 gene, gene product, and/or protein. One of ordinary skill in the art will instantly appreciate RNA and protein variants, homologues, orthologues, and analogues of the STEAP3 in humans and animals. For example, the STEAP3mRNA can have a nucleotide sequence as specified by, but not limited to, any of GenBank Accession number(s) NM_182915.2. Other mRNA sequences that can be translated to form a STEAP3 protein or variant thereof in human or other animal species can be identified and detected by one of ordinary skill in the art using techniques generally known to one of ordinary skill in the art. Similarly, STEAP3 protein can have a polypeptide sequences as specified by, but not limited to, any of GenBank Accession number(s) NP_878919.2. Other STEAP3 polypeptides in human or other animal species can be identified and detected by one of ordinary skill in the art using techniques generally known to one of ordinary skill in the art.

As used herein, the abbreviation "AMT1B" can refer to the ammonium transport protein 1B gene, gene product, and/or protein. One of ordinary skill in the art will instantly appreciate RNA and protein variants, homologues, orthologues, and analogues of the AMT1B in bacteria, fungi, humans, and animals. For example, the AMT1B mRNA can have a nucleotide sequence as specified by, but not limited to, any of GenBank Accession number(s) XM_001692619.1. Other mRNA sequences that can be translated to form an AMT1B protein or variant thereof in human or other animal species can be identified and detected by one of ordinary skill in the art using techniques generally known by one of ordinary skill in the art. Similarly, AMT1B protein can have a polypeptide sequences as specified by, but not limited to, any of GenBank Accession number(s) XM_001692619.1. Other AMT1B polypeptides in human or other animal species can be identified and detected by one of ordinary skill in the art using techniques generally known to one of ordinary skill in the art.

SEQ ID NOs: for the various accession numbers specifically provided herein can be found in Table 1. Other variants of the sequences that correspond with the genes, gene products, and proteins provided herein will be appreciated by those of ordinary skill in the art and are within the scope of this disclosure.

Discussion

In most tissues, including the pancreas, a mature cell performing a specialized function represents a terminally differentiated cell that is restricted in potential. In other words, most mature cells possess the ability to carry out specific functions but lack the ability to replicate and expand the pool of cells. In contrast, progenitor cells typically lack very specific functionality but have the capacity and plasticity to proliferate and expand a pool of cells. In some instances it is desirable, particularly for the development of in vitro culture systems for cells to exhibit specific functionalities attributed to a terminally differentiated cell yet continue to proliferate to allow for culture in vitro.

It was once believed that differentiation was a one-way fate. However, it is now known that it is possible to reprogram differentiated cells to cell having more plasticity that can be directed down a different differentiation pathway. Pancreatic cells (including alpha and beta cells) are derived from a common progenitor. Many examples exist of fate conversion between endocrine cell types. Further exocrine cells, particularly acinar cells, have been used to convert the exocrine cells into an endocrine lineage, specifically pancreatic beta cells.

A major, yet poorly understood, feature of type 2 diabetes is the excessive hepatic glucose production and the corresponding insulin resistance leading to fasting hyperglycemia. Recent work has demonstrated an increased daily and unregulated plasma glucagon in concentration in type 2 diabetics. Glucagon secretion by pancreatic alpha-cells is an immediate response to glucopenia. Abnormal secretion of glucagon and other counterregulatory hormones is a hallmark of types 1 and 2 diabetes and a major limitation to the use of strong hypoglycemia agents. As such there exists a need for improved diabetes treatments, of which some may target the pancreatic alpha cells and dysregulation of glucagon secretion.

With that said, described herein are methods of transdifferentiating preadipocytes into, inter alia, pancreatic cells (e.g. pancreatic alpha cells), populations of transdifferentiated preadipocytes, and assays using the transdifferentiated preadipocytes to evaluate the effect of candidate compounds on a characteristic of the transdifferentiated preadipocyte.

Other compositions, compounds, methods, features, and advantages of the present disclosure will be or become apparent to one having ordinary skill in the art upon examination of the following drawings, detailed description, and examples. It is intended that all such additional compositions, compounds, methods, features, and advantages be included within this description, and be within the scope of the present disclosure.

Methods of Transdifferentiating Preadipocytes

Described herein are methods of transdifferentiating preadipocytes. Preadipocytes can be differentiated into hematopoietic, neuronal, and/or pancreatic cells. In some embodiments, the preadipocytes can be transdifferentiated into pancreatic alpha cells. In some embodiments, preadipocytes can be transdifferentiated by overexpressing Oct4 in the preadipocytes. In some embodiments, the preadipocytes can be transdifferentiated by overexpressing Oct4 with at least one other factor from the group of Klf4, Sox2, and cMyc. In some embodiments, the preadipocytes can be transdifferentiated by overexpressing Oct4 and Klf4. In some embodiments, the preadipocytes can be transdifferentiated by overexpressing Oct4, Klf4, and Sox2. In some embodiments, the preadipocytes can be transdifferentiated by overexpressing Oct4, Klf4, Sox2, and cMyc. In embodiments where Oct4 is overexpressed in the preadipocyte with at least one other factor from the group of Klf4, Sox2, and cMyc, the additional factor(s) can be overexpressed at the same (simultaneously) or at different times than the Oct4. In some embodiments, preadipocytes can be transdifferentiated without overexpressing Klf4, Sox2, and/or cMyc. Overexpression of Oct4, In some embodiments, preadipocytes can be transdifferentiated by overexpressing Oct 4, Klf4, Sox2, and/or cMyc in the preadipocytes followed by culturing the cells until about 100% confluent, after which, the cells can be passaged and a subset of cells can be reseeded onto a feeder cell layer. The cells can then be expanded on the feeder layer until the desired differentiated cell type is achieved.

During the first culture period, cells can be cultured in a preadipocyte growth medium. In some embodiments the preadipocyte growth medium can contain Dulbecco's modified Eagle medium (DMEM) supplemented with FBS at about 10% and suitable antibiotics. In embodiments, after passaging, cells or subset thereof can be reseeded and expanded on the feeder layer in a suitable stem cell culture medium, such as, but not limited to, mTeSR1 media. In some embodiments, the first culture period can be anywhere from about 1-7 or more days. In other words, the cells can be cultured after transfection or transduction for about 1-7 days without passaging. In some embodiments, the cells can be expanded on the feeder layer for about 1-10 days.

Oct4, Klf4, Sox2, and/or cMyc can be ectopically (or exogenously) expressed or overexpressed in preadipocytes by any suitable method. Suitable methods include, but are not limited to viral-based and non-viral based transduction and transfection techniques. Viral based techniques can include those that involve adenoviral, lentiviral, and retroviral systems. Non-virus based techniques include liposomal and micelle delivery reagents. In some embodiments, the transgene can be incorporated into the genome utilizing CRISPR or other genome modification technique known by those of skill in the art. In some embodiments, expression or overexpression of Oct4, Klf4, Sox2, and/or cMyc can be transient or stable. In some embodiments, expression or overexpression of Oct4, Klf4, Sox2, and/or cMyc can be inducible. The preadipocytes can be transfected or transduced 1, 2, 3, 4, or more times with the same or different transgene(s).

Preadipocytes can be harvested from adipose tissue. In some embodiments, the preadipocytes can be obtained from the stromal vascular fraction of adipose tissue. In some embodiments the preadipocytes that are transfected or transduced are low passage preadipocytes. As used herein, "low passage" can refer to cells that have undergone 3 or less passages.

Transdifferentiated Cells

Also described herein are cells derived from transdifferentiated from preadipocytes according to the methods described herein. Insofar as these cells are transdifferentiated by at least exogenous expression of Oct4, these cells are not identical to preadipocytes or differentiated cells even if there are similarities in function or structure to a native or natural cell, such as an isolated preadipocyte or pancreatic cell, and thus not a product of nature.

In some embodiments, the transdifferentiated cells (also referred to herein as transdifferentiated preadipocytes) can have ectopic expression of Oct4. The transdifferentiated preadipocytes can also have ectopic expression of Klf4, Sox2, and/or cMyc. In some embodiments the transdifferentiated preadipocytes only have ectopic expression of Oct4. In further embodiments, the transdifferentiated preadipocytes only have ectopic expression of Oct4 and Klf4. Stated differently, in some embodiments, the transdifferentiated preadipocytes having ectopic expression of Oct4 do not have ectopic expression of Klf4, Sox2, and/or cMyc.

While transdifferentiated preadipocytes can be similar in function, genotype, phenotype, and/or structure to native pancreatic cells (e.g. pancreatic alpha or beta cells), neuronal cells, and/or hematopoietic cells, the populations of cells provided herein are not native or natural "isolated" pancreatic cells, neuronal cells, and/or hematopoietic cells insofar as they can have differing expression patterns (or profiles) of genes and/or proteins as described herein and/or have exogenous expression of one or more genes and/or proteins (e.g. Oct4) as described herein. These non-natural cells can be referred to herein as pancreatic cells, neuronal cells, and hematopoietic cells.

In some embodiments the transdifferentiated preadipocytes can express NeuroD protein. In this way, the transdifferentiated preadipocytes can be similar to pancreatic alpha cells. In some embodiments, the transdifferentiated preadipocytes have increased expression of a pancreatic alpha cell specific gene as compared to an unmodified preadipocyte. The pancreatic alpha cell specific gene that can control pancreatic hormone expression and processing can be any one of GCG, CNTN1, PCSK1, PDK4, RGS4, IRX2, LPPR4, LOXL2, KCTD12, KL, and any combination thereof. In some embodiments, the transdifferentiated preadipocytes have increased expression of a pancreatic cell specific gene as compared to an unmodified preadipocyte. The pancreatic progenitor cell specific gene can be any one of RBPJ, Sox9, NeuroD, ISL1, RGS2, IL8, KCTD12, AKAP7, PCSK1, LOXL4, CPE, OAS1, PLTP, RNF128, BEX1, CEBPD, HIST2H2BE, HDAC9, KCNJ2, and combinations thereof. In some embodiments, the transdifferentiated preadipocytes can have reduced RNA expression of CD36 that is a marker for adipocyte stem cells as compared to an unmodified preadipocyte. In further embodiments, the transdifferentiated preadipocyte can have reduced RNA expression of FABP4 that is highly expressed in adipocytes manner as compared to an unmodified preadipocyte.

The transdifferentiated preadipocytes can have increased expression of a hematopoietic cell specific gene as compared to an unmodified preadipocyte cell. In some embodiments, the hematopoietic cell specific gene can be any one of CD71+, CHST2, AMPD3, CD58, STEAP3, MINPP1, IDH2, CD70, HLA-DRA, NX1, CD83, CD74, IFI44L, BST2, ISG15, CLIC6, PBX3, TOX2, HOPS, RAC2, RGS1, STAT4, HLA-DMB, NT5E, BTG1, CD14+, F13A1, FGL2, FOLR3, MX1, PSENEN, RGS1, and combinations thereof.

The transdifferentiated preadipocytes can have increased expression of a neural cell specific gene as compared to an unmodified preadipocyte. In some embodiments, the hematopoietic cell specific gene can be any one of IFI6, HS3ST2, TAGLN3, SV2B, NCALD, ENC1, COBL, EEF1A2, KBTBD11, RGL1, CA11, NETO2, DOK5, TUBB2B, PCDH19, PTPRO, SATB2, FGF13, CXADR, LPPR4, MLLT11, TMEFF2, BRSK1, NRGN, TAC1, PCDH19, CDH10, TPD52L1, HIST2H2BE, SLC16A9, MEGF10, FMNL2, EEF1A2, KIAA1598, DNER, CALB2, KAL1, and combinations thereof.

In some embodiments, the transdifferentiated cells can be provided in a cell culture vessel including flasks, tubes, and multi-well plates. The transdifferentiated cells can be provided in a cell culture vessel at any stage of transdifferentiation. In some embodiments, the cells can be seeded on a feeder layer in a cell culture vessel or on another substrate such as an extracellular matrix (synthetic or natural) composition. Other suitable substrates will be appreciated by those of skill in the art. In some embodiments, the cell culture vessel contains one or more trans-wells.

Uses of the Transdifferentiated Cells

The transdifferentiated preadipocytes described herein can be used to test compounds for their effect on a characteristic of the transdifferentiated preadipocytes. In some embodiments, the test compounds are candidate pharmaceutical compounds. In short, the transdifferentiated preadipocytes can be used in a drug or compound screening assay. As described herein are methods of evaluating a candidate compound including the step of contacting a population of transdifferentiated cells, such as pancreatic alpha cells, with an amount of a candidate compound. In some embodiments, cell growth, pancreatic cell development and differentiation, glucagon production, apoptosis, cytotoxicity, pancreatic cell replacement therapy are measured after contacting a population of transdifferentiated preadipocytes with a test compound.

EXAMPLES

Now having described the embodiments of the present disclosure, in general, the following Examples describe some additional embodiments of the present disclosure. While embodiments of the present disclosure are described in connection with the following examples and the corresponding text and figures, there is no intent to limit embodiments of the present disclosure to this description. On the contrary, the intent is to cover all alternatives, modifications, and equivalents included within the spirit and scope of embodiments of the present disclosure.

Example 1

Introduction

Overexpression of defined transcription factors can convert one cell type into another and has important implications for regenerative medicine. Ectopic expression of key transcription factors in somatic donor cells has been used to generate many different cell types, including cells resembling blood cells [1, 2], brown fat cells [3], hepatocytes [4], sertoli cells [5], and various cell types of the neural lineage [6-9].

Expression of Oct4, partially in conjunction with Klf4, is involved in maintaining pluripotency at early developmental stages including in the blastomere, inner cell mass and epiblast. Oct4 and Klf4 have been reported as components of four defined transcription factors (Oct4, Sox2, Klf4, cMyc) that trigger reprogramming of somatic cells into pluripotent stem cells (iPS cell) that are functionally identical to embryonic stem cells (ESCs) [10]. Ectopic expression of Oct4 alone, or ectopic expression of Oct4 and Klf4, in combination with small molecule treatment, can be sufficient to generate iPS cells from neural stem cells, mouse embryonic fibroblasts (MEF) and dermal papilla cells [11-14]. Oct4 activates early epithelial-to-mesenchymal transition (EMT), which is involved in somatic cell reprogramming [15]. Szabo and colleagues observed direct conversion of human dermal fibroblasts into multipotent blood progenitors by ectopic expression of Oct4 [16]. This suggests that Oct4 can function as a haematopoietic lineage differentiation marker as well. This Example demonstrates that Oct4 and Klf4 can induce transdifferentiation of human preadipocytes into three different lineages including hematopoietic, neuronal and pancreatic endocrine cells. Furthermore, ectopic expression of Oct4 alone can induce transdifferentiation of preadipocytes into glucagon expressing pancreatic α cells.

Results

Figure 16A:
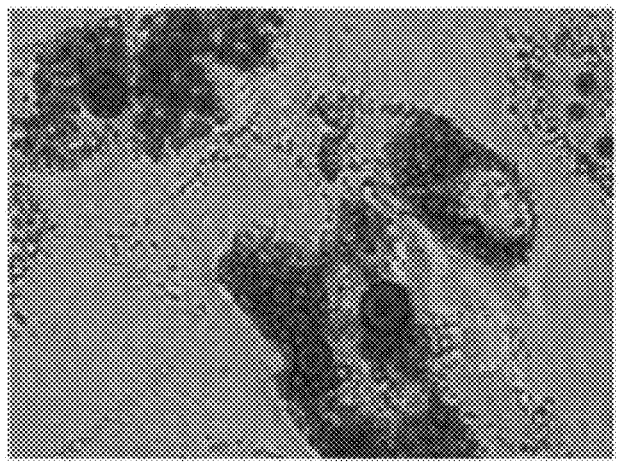
FIGS. 16A-16C show micrograph images of preadipocytes that have been transdifferentiated down adipogenic (FIG. 16A), chondrogenic (FIG. 16B), and osteogenic (FIG. 16C) lineages.
Figure 16B:
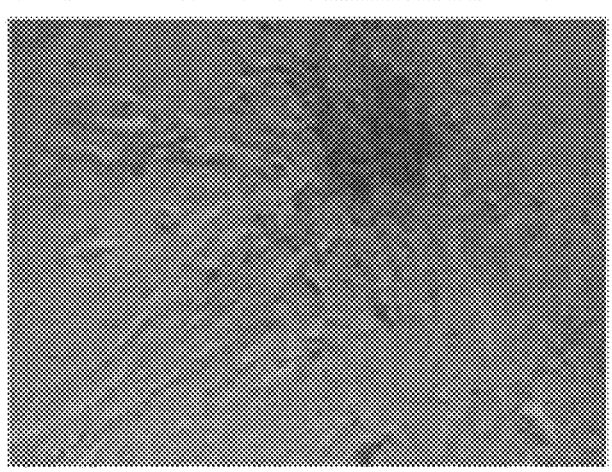
Figure 16C:
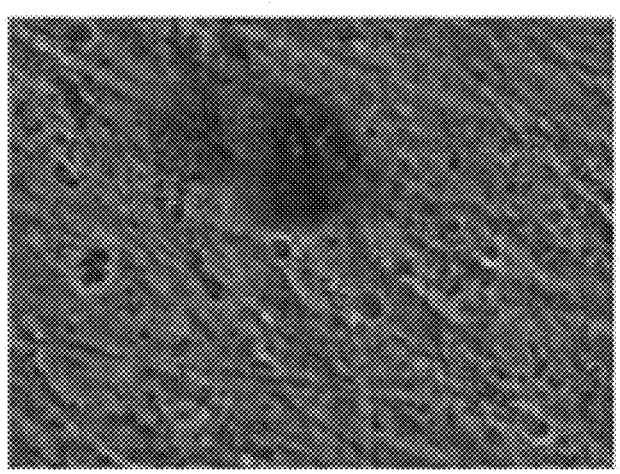
Figure 17A:
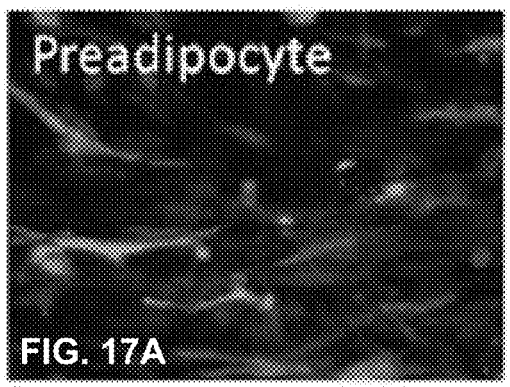
FIGS. 17A-17D show fluorescent micrograph images of 2 factor (OK) and 4 factor (OKSM) transfected cells using highly proliferative, low passage preadipocytes (<3 passages).
Figure 17B:
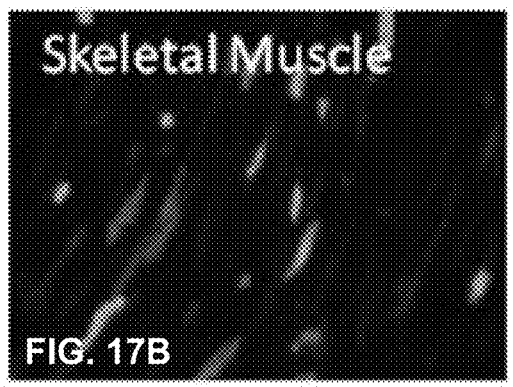
Figure 17C:
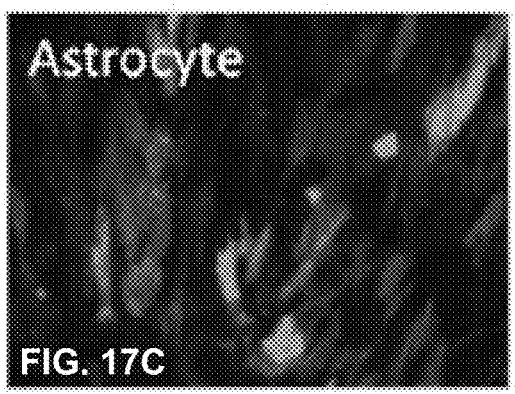
Figure 17D:
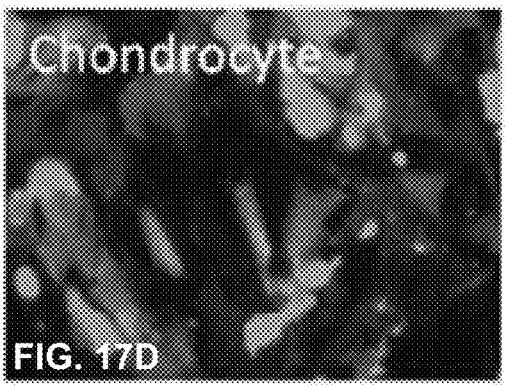
Figure 18:
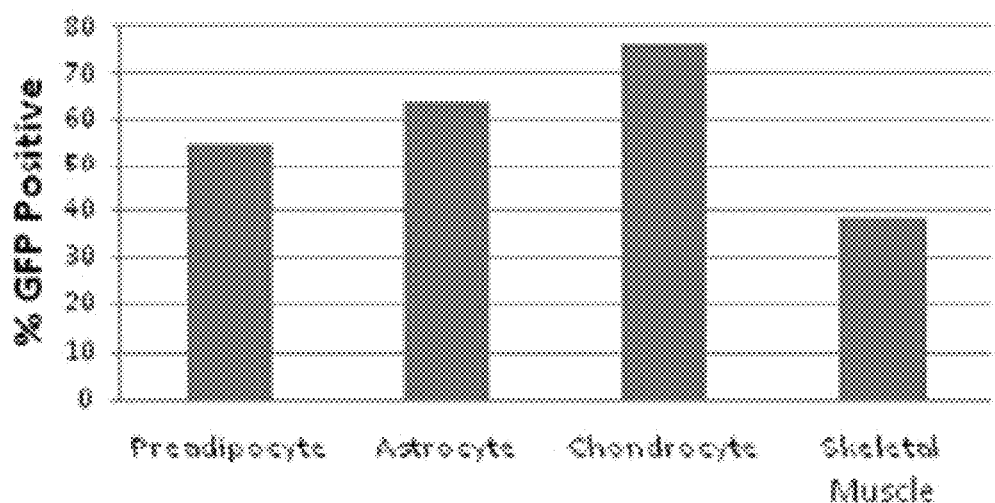
FIG. 18 shows a graph demonstrating the percent of GFP positive cells in the cell populations shown in FIGS. 17A-17D, which indicates lentiviral transduction rates.

Ectopic Expression of Oct4 and Klf4 can Induce Transdifferentiation of Human Preadipocytes. Primary cultures of preadipocytes from stromal vascular fraction (SVF) of adipose tissues are a rich source of CD34 and alkaline phosphatase positive adult mesenchymal stem cells [17]. Preadipocytes can differentiate toward mesodermal lineages including osteocyte, adipocyte and chondrocyte (FIGS. 16A-16C). Two factor (OK) and 4 factor (OKSM) transfected cells were generated using highly proliferative, low passage preadipocytes (<3 passages) that had been demonstrated to have approximately 50% transfection yields using a lentiviral vector (FIGS. 17A-17D and 18). FIGS. 1 and 2A-2D show the general strategy. One day before lentiviral infection, cells were seeded on 6 well plates at a concentration of $10^5$ cells per well with Dulbecco's Modified Eagle's medium (DMEM) containing 10% FBS. For the lentiviral infection, total 25 multiplicity of infection (MOI) of lentivirus which expresses Oct4, Klf4 under control of CMV promoter (SBI and Cellomics) or polycistronic lentivirus STEMCCA which express four iPS factors (Oct4, Sox2, Klf4, cMyc) were added to the medium with 5 μg/ml polybrene (Sigma-Aldrich) (FIGS. 1 and 2A-2D).

The lentiviral infection was repeated the next day, and the culture medium was changed with fresh DMEM/5% FBS medium every other day. When cells became confluent, they were trypsinized, counted and seeded on MEF feeder layer at a density of $5 \times 10^4$ cells/ml with mTeSR1 medium (StemCell Technology). Emerging of round cells with colony formation was observed as early as 5 days post feeder layer cultures. The two factor (OK) transfected cells showed similar morphological changes when compared to four iPS factor (OSKM) transfected cells that were undergoing early stages of somatic cell reprogramming (FIGS. 1 and 2A-2D) with the exception that more dense colony formation and immortalization from the OSKM overexpressed iPS colonies (AdiPS cells) was observed. Similar morphological changes have been shown from multi-lineage blood progenitors through overexpression of Oct4 in human adult dermal and neonatal foreskin fibroblasts [16]. Nine OK cell lines and multiple iPS cell lines were established from OSKM overexpressed preadipocytes by colony picking.

Figure 4:
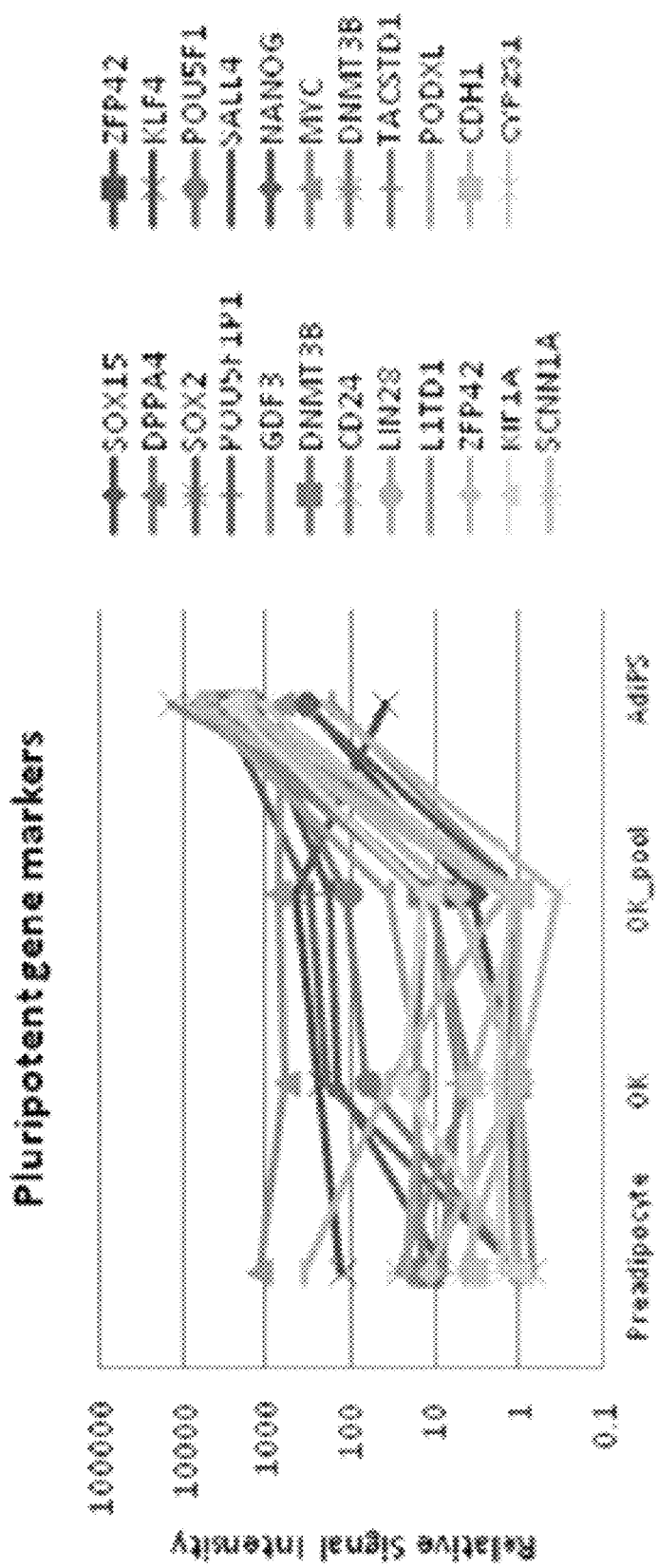
FIG. 4 shows a graph demonstrating relative signal intensity from microarray displays no significant changes in pluripotent markers that highly expressed in the fully reprogrammed AdiPS cells.
Figure 5:
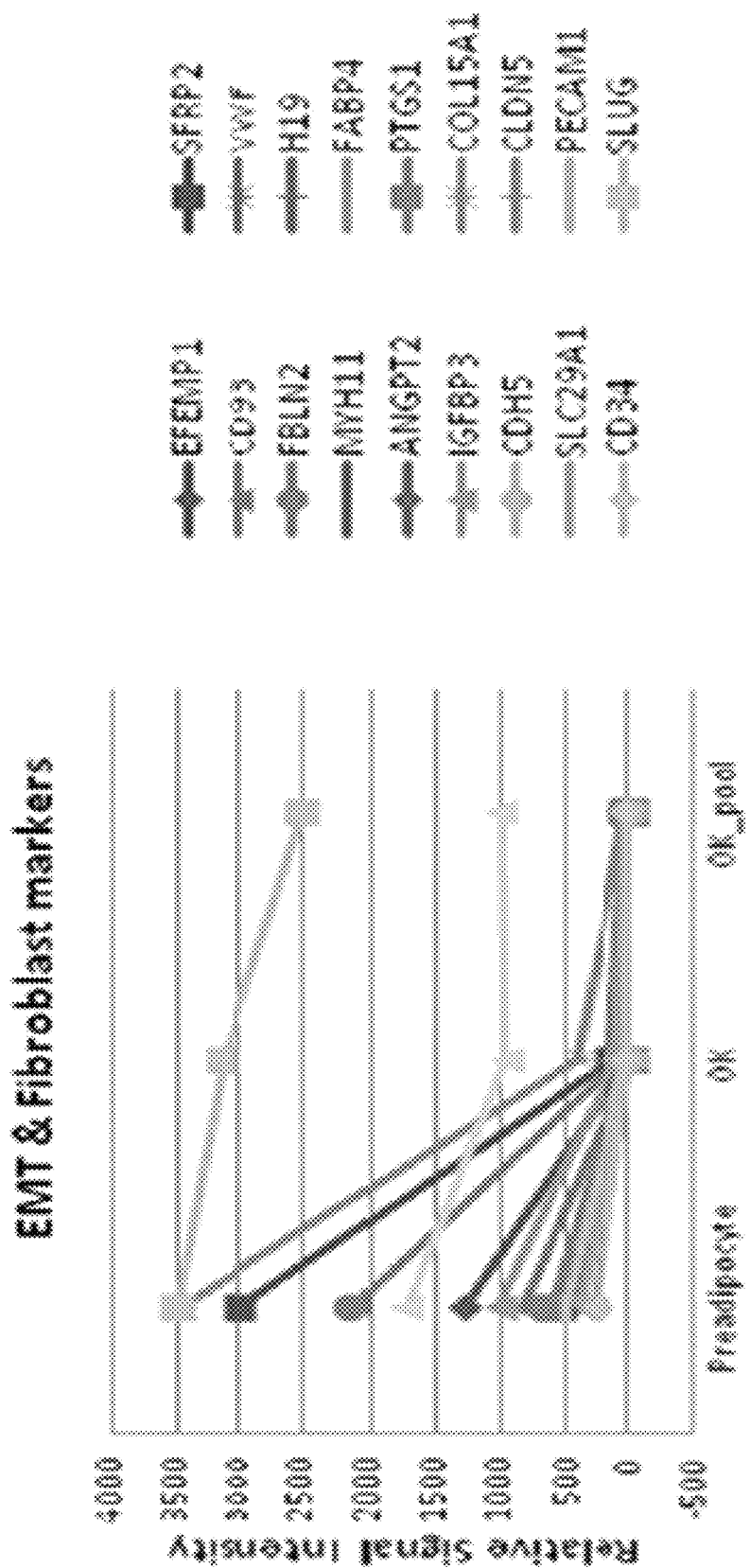
FIG. 5 shows a graph demonstrating relative signal intensity from microarray displays down regulation of fibroblast markers while the expression of EMT activators (Slug, N-Cad) maintains highly.

To further characterize OK transfected cells, global gene expression patterns were examined using microarray analysis (Illumina). Sample relations based on the expression of 20,909 genes showed that OK cells (single clone, mixed colonies) are distinct from preadipocyte and four factor (OSKM) induced iPS cells (AdiPS) (FIG. 3). A majority of the pluripotency genes that were highly expressed in the fully reprogrammed AdiPS cells were expressed at lower levels in two factor induced OK cells, but at levels similar to or less than levels observed in preadipocytes (FIG. 4). Expression of fibroblast and preadipocyte marker genes were expressed at lower levels in OK cells with the exception EMT activators (Slug, N-Cad) which maintained higher expression levels (FIG. 5). In contrast to a previous report [15], this suggested that OK cells underwent an epithelialto-mesenchymal transition (EMT) rather than reprogramming processes. Epigenetic modifiers including inhibitors for histone deacetylase (HDAC), histone methyltransferase (HMT) and DNA methyltransferase (DNMT) are known to facilitate the reprogramming process by targeting epigenetic barriers [18-20]. Small molecule combination treatments (e.g., BIX-01294, BayK8644, RG-108) have been reported to enable two factor (Oct4 and Klf4) induced reprogramming of mouse embryonic fibroblasts [18]. In this Example, exposure to the DNMT1 inhibitor Zebularine did not affect reprogramming or global gene expression patterns (data not shown).

Figure 6:
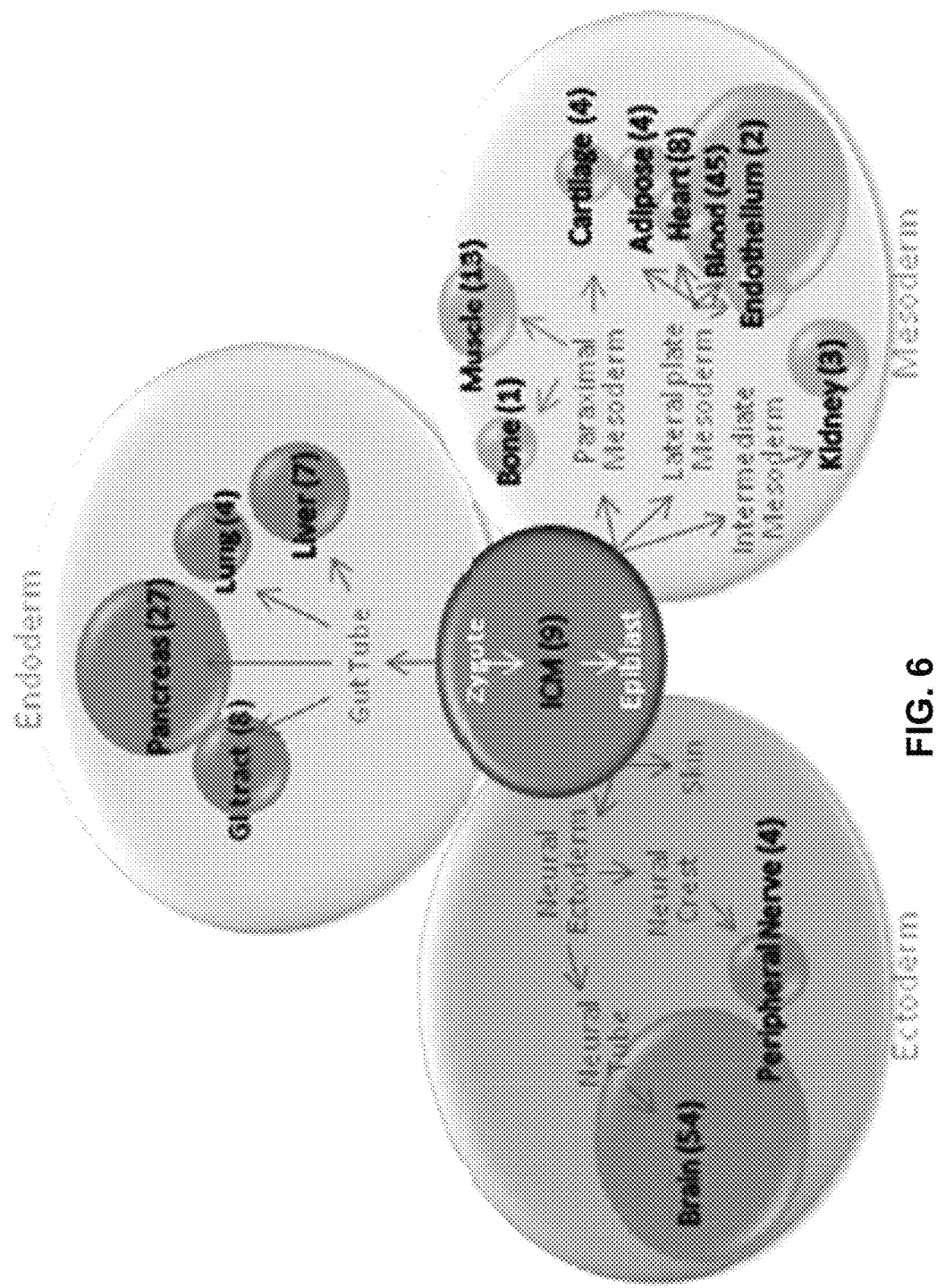
FIG. 6 shows a diagram of BioGPS gene annotation in transdifferentiated preadipocytes expressing ectopic Oct4 and Klf4. The number of lineage and tissue specific genes is summarized.
Figure 7:
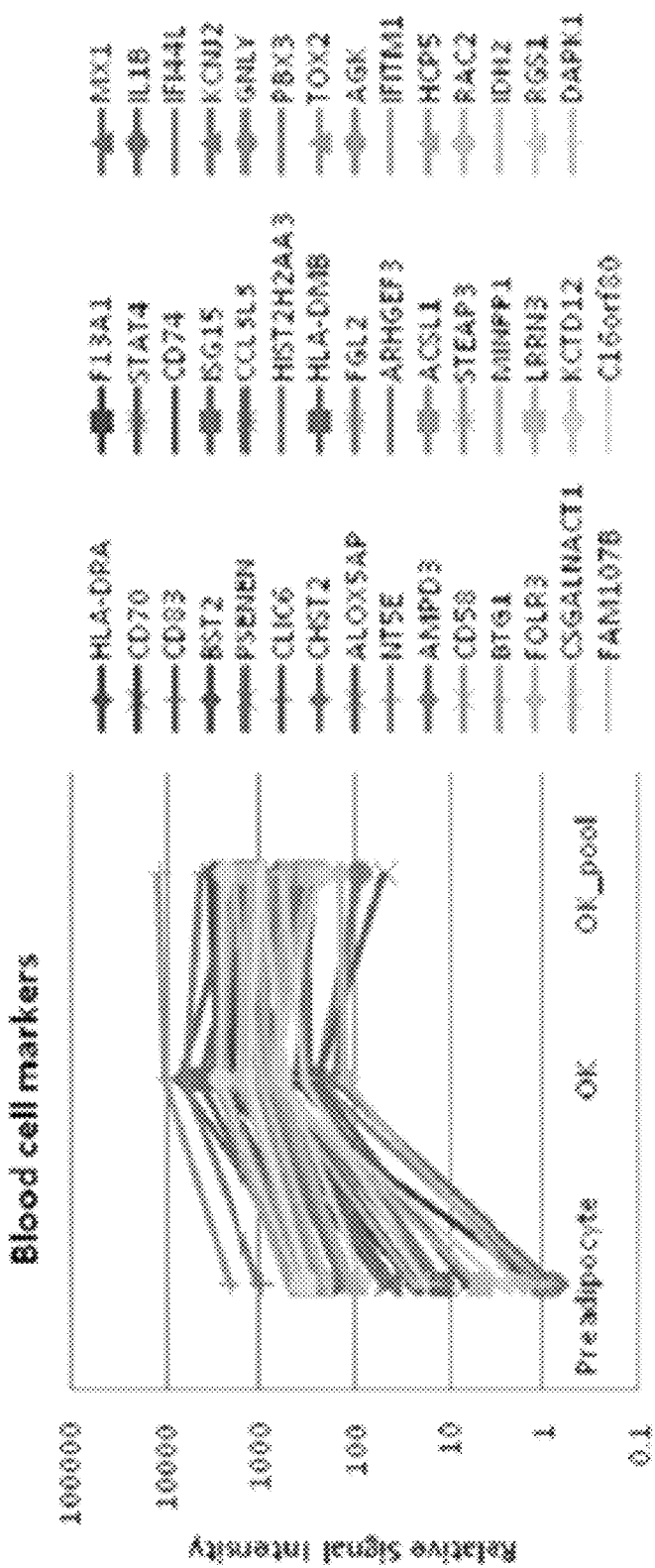
FIG. 7 shows a graph demonstrating relative signal intensity from microarray displays upregulation of blood cell specific gene expression from two factor induced OK cell (Single clone) and OK_pool (mixed colonies).
Figure 19:
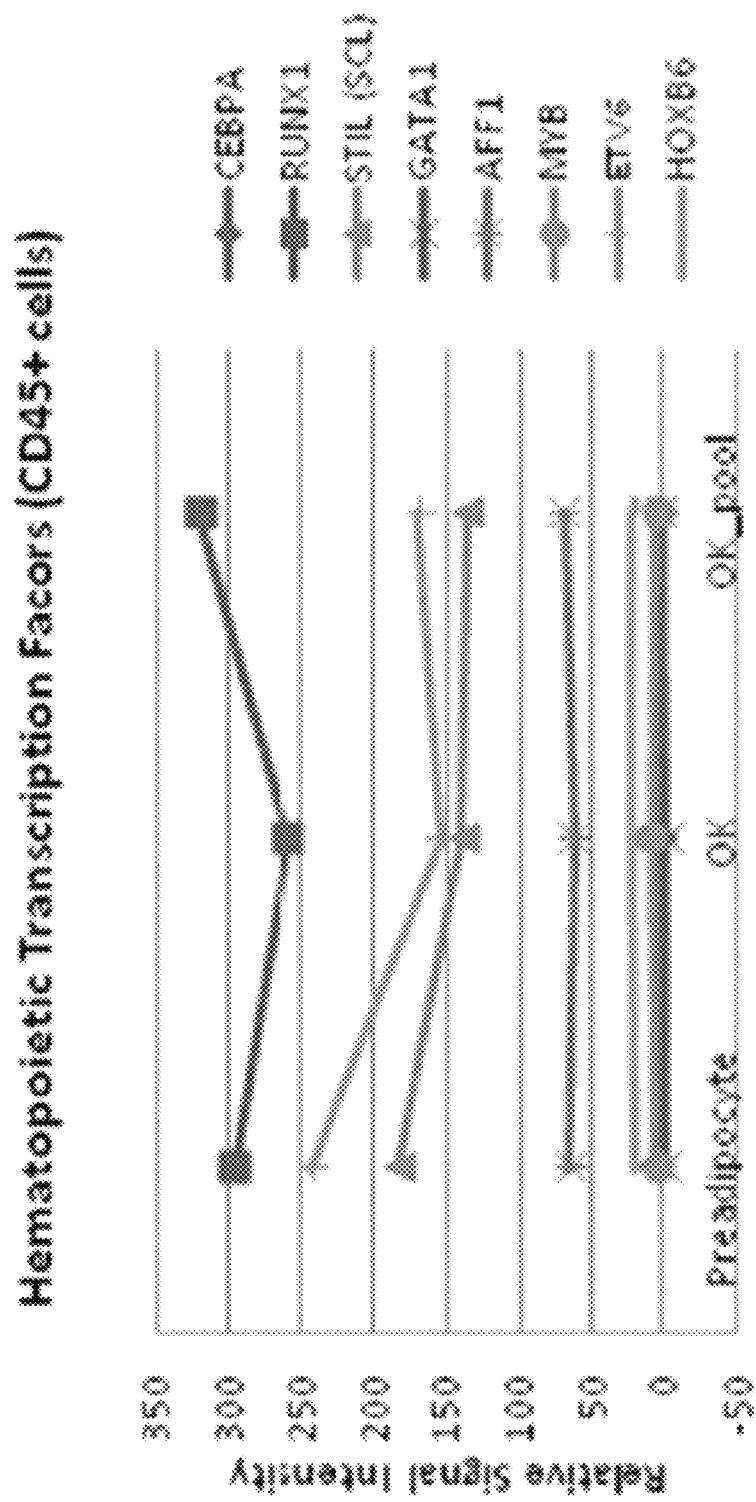
FIG. 19 shows a graph demonstrating expression of hematopoietic transcription factors (CD45+ cells) in preadipocytes, OK cells, and OK_pool.
Figure 20:
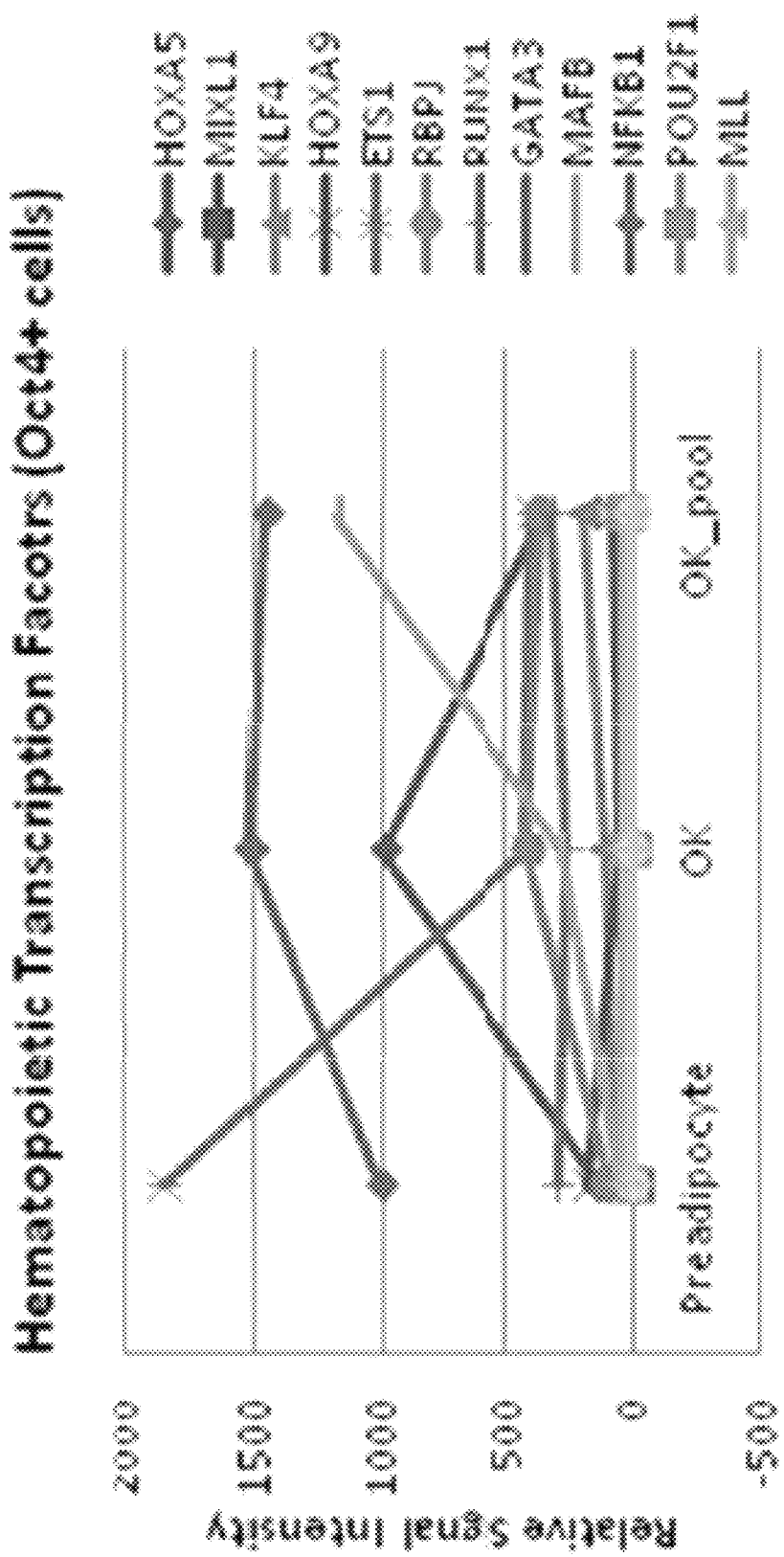
FIG. 20 shows a graph demonstrating expression of hematopoietic transcription factors (Oct4+ cells) in preadipocytes, OK cells, and OK_pool.
Figure 21:
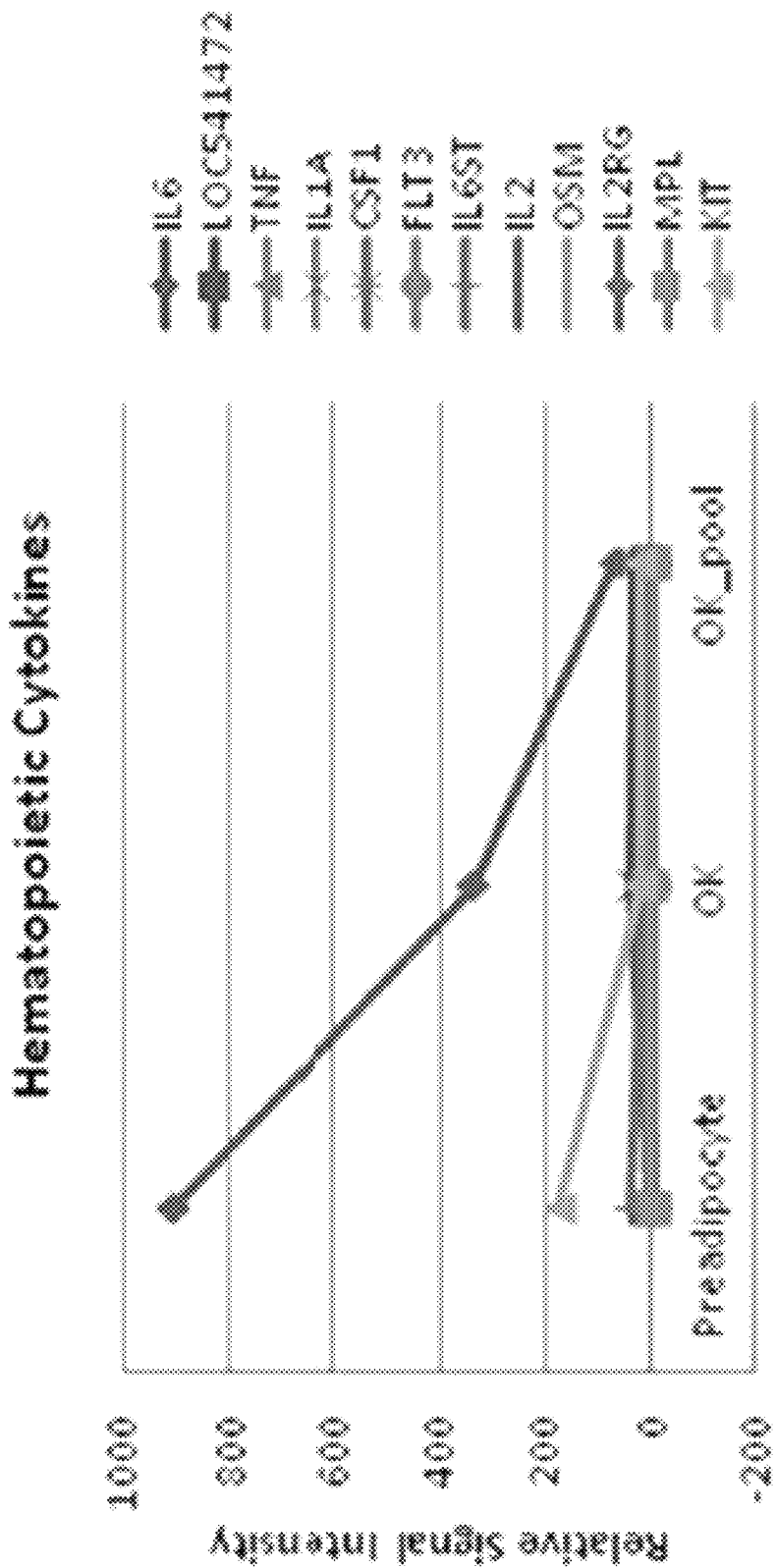
FIG. 21 shows a graph demonstrating expression of hematopoietic cytokines in preadipocytes, OK cells, and OK_pool.

Transdifferentiation of Hematopoietic and Neuronal Lineages by Oct4 and Klf4 Overexpression. Using a BioGPS gene annotation portal (www.biogps.org), we analyzed lineage and tissue specific expression profiles of the top 292 genes characterized by a minimum 4 fold-change induced by Oct4 and Klf4 overexpression. As summarized in FIG. 6, enrichments of specific genes from three germ layers (mesoderm, ectoderm and endoderm) and inner cell mass (ICM) were observed. Overall, 41% of selected genes are annotated as tissue specific expression while the remaining is ubiquitously expressed. Specifically, a total of 45 genes are designated hematopoietic cell specific, 59 genes are brain and peripheral nerve specific, and 27 genes are exclusively expressed from pancreas and pancreatic islets. Oct4 can also function as a hematopoietic transcription factor that enhances the expression of panleukocyte marker CD45 in human fibroblasts [16]. Oct4-derived fibroblasts (CD45+ FibOct4) can differentiate into mature blood cells by additional cytokine treatments. Unlike the Oct4-derived fibroblasts (FibOct4, CD45+ FibOct4), OK cells were not observed to alter expression of hematopoietic transcription factors and cytokines (FIGS. 19-21). However, OK cells were observed to have upregulation of CD71+, early erythroid marker genes (CHST2, AMPD3, CD58, STEAP3, MINPP1, IDH2), lymphoblasts marker genes (CD70, HLA-DRA, MX1, CD83, CD74, IFI44L, BST2, ISG15, CLIC6, PBX3, TOX2, HCP5, RAC2, RGS1), lymphocyte marker genes (STAT4, HLA-DMB, NT5E, HCP5, RAC2, BTG1) and CD14+ monocyte/dendritic cell marker genes (F13A1, FGL2, FOLR3, MX1, PSENEN, RGS1) (FIG. 7).

Figure 8:
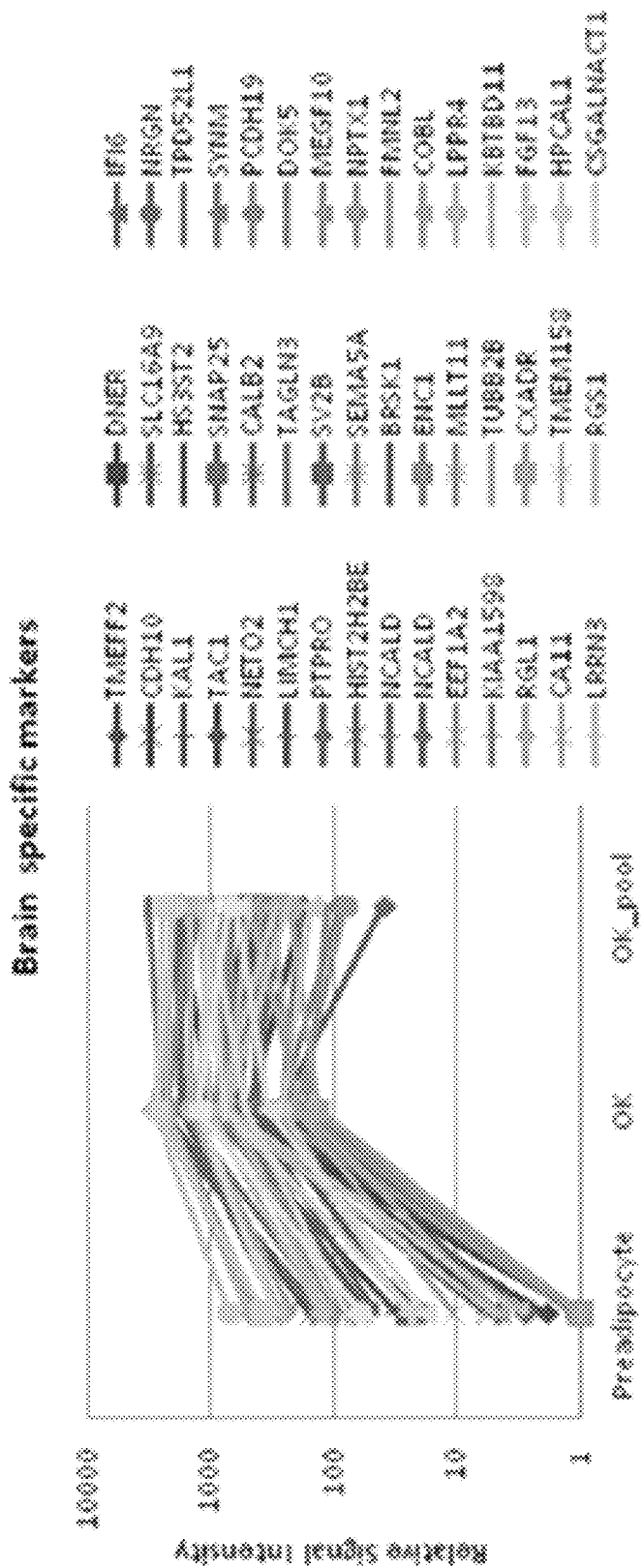
FIG. 8 shows a graph demonstrating brain specific gene expression in transdifferentiated preadipocytes.

Direct conversion of mouse fibroblasts into neurons by the combinatorial expression of neural lineage specific transcription factors (Ascl1, Brn2, Myt1l) has been demonstrated [6]. In addition, four reprogramming factor (Oct4, Sox2, Klf4, cMyc) induced intermediate cells have been identified as neural progenitor cells [21]. Tissue-specific gene expression pattern analysis revealed that OK cells expressed increased levels of brain specific markers (IFI6, HS3ST2, TAGLN3, SV2B, NCALD, ENC1, COBL, EEF1A2, KBTBD11, RGL1, CA11). Some genes are known to be exclusively expressed from fetal brain (NETO2, DOK5, TUBB2B, PCDH19, PTPRO, SATB2, FGF13, CXADR, LPPR4, MLLT11) or regions specific to the amygdala (TMEFF2, BRSK1, NRGN, TAC1P, CDH19), pineal glands (CDH10, TPD52L1, HIST2H2BE, NCALD, CXADR), prefrontal and cortex (SLC16A9, NRGN, MEGF10, FMNL2, EEF1A2, KIAA1598, KBTBD11, RGL1, CA11, SATB2), hypothalamus and thalamus (DNER, CALB2, FMNL2, KIAA1598), and spinal cord (KAL1, DNER, MEGF10). Most of the brain specific genes that were highly induced in OK cells were undetectable or at very low levels when compared to untransfected human preadipocytes (FIG. 8). Neuronal differentiation, however, did not proceed any further: OK cells did not show neuronal morphological changes such as neuronal rosettes or nerve fibers (axon) (data not shown). In addition, the expression of neural lineage-specific transcription factors (Ascl1, Brn2, Myt1l) were not altered in OK cells. Without being bound by theory, these results suggest that Oct4 and Klf4 induced neural transdifferentiation can be independent of neural development, and that Oct4 and Klf4 overexpression directly convert mesoderm to ectoderm lineages.

Figure 9:
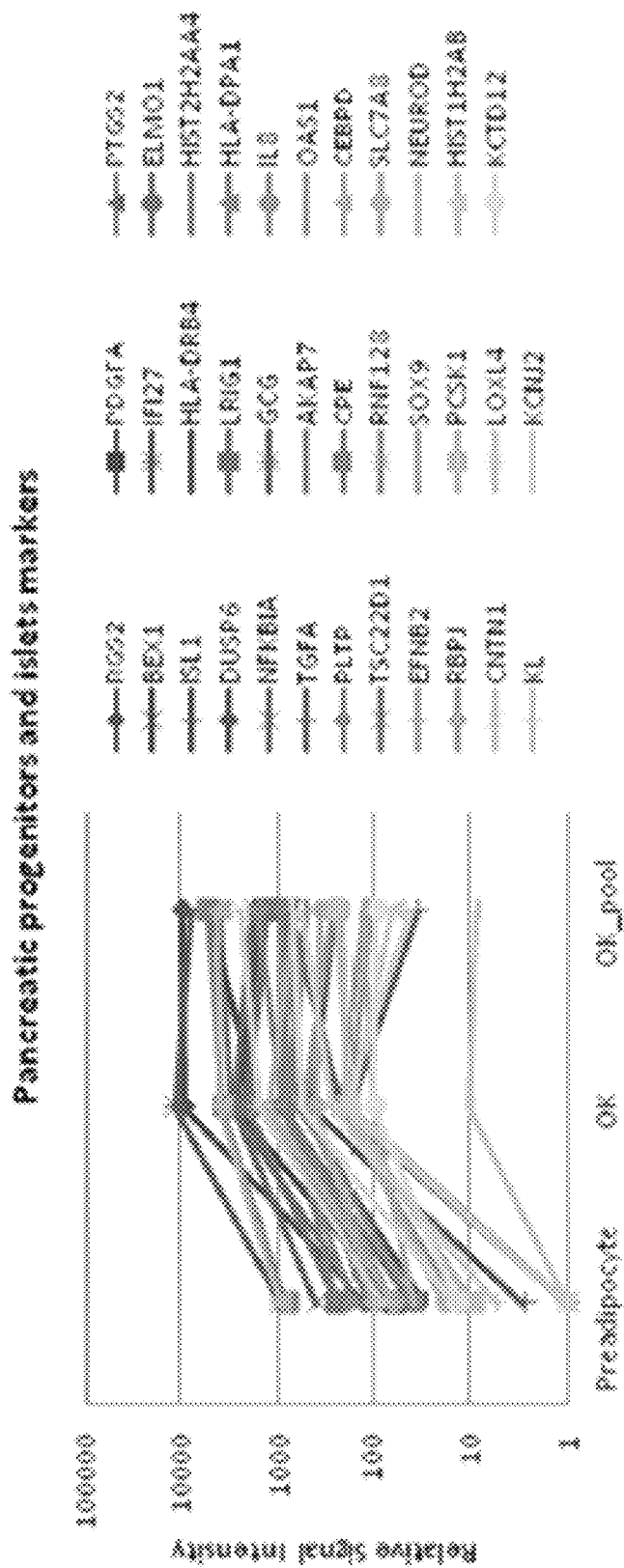
FIG. 9 shows a graph demonstrating pancreatic progenitor and islet specific gene expression in transdifferentiated preadipocytes.

Transdifferentiation of Pancreatic α Cells by Oct4/Klf4 or Oct4 Alone. As a part of an endocrine organ, pancreatic α and β cells play vital roles maintaining blood glucose homeostasis by secreting glucagon and insulin, respectively. Three of pancreatic lineage specific transdifferentiation factors (Pdx1, Ngn3, Mafa) have been identified that efficiently convert adult hepatocytes and pancreatic exocrine cells into insulin secreting pancreatic β cells [22-25]. However, pancreatic α cell specific transdifferentiation has not been reported. Global gene expression analysis indicated that 27 pancreatic islet specific genes were enriched in OK cells including pancreatic progenitor markers (RBPJ, Sox9, NeuroD and ISL1) (FIG. 9). The enriched genes are functionally associated with G protein related cell signaling and which are responsible for glucose sensing (RGS2, 1L8, KCTD12, AKAP7), transcription regulation (ISL1, BEX1, CEBPD, HIST2H2BE, NEUROD, SOX9, RBPJ) and enzymes for pancreatic hormone processing (PCSK1, LOXL4, CPE, OAS1, PLTP, RNF128). Among the four pancreatic hormones that secret from distinct cells in the pancreatic islets, upregulation of glucagon (GCG) gene (FIG. 9) was observed, but not insulin, somatostatin, or pancreatic polypeptide (data not shown). Without being bound by theory, these results suggest that human preadipocytes can be directly converted to pancreatic α cells by Oct4 and Klf4 overexpression.

Figure 10A:
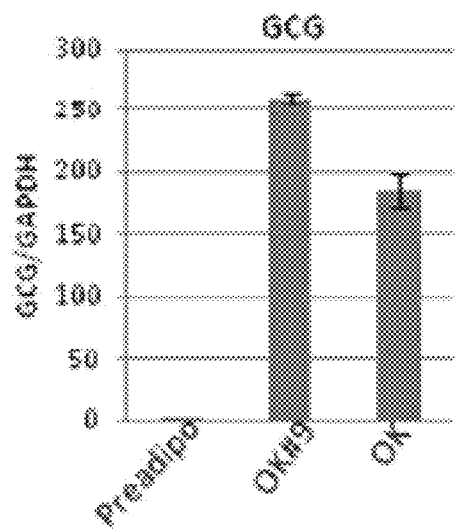
FIGS. 10A-10O show graphs demonstrating expression of genes GCG (FIG. 10A), IRX (FIG. 10B), PCSK1 (FIG. 10C), PDK4 (FIG. 10D), RGS4 (FIG. 10E), CNTN1 (FIG. 10F), LPPR4 (FIG. 10G), LOXL2 (FIG. 10H), KCTD12 (FIG. 10I), KL (FIG. 10J), ISL1 (FIG. 10K), HDAC9 (FIG. 10L), KCNJ2 (FIG. 10M), CD36 (FIG. 10N), FABP4 (FIG. 10O) from transdifferentiated preadipocytes.
Figure 10B:
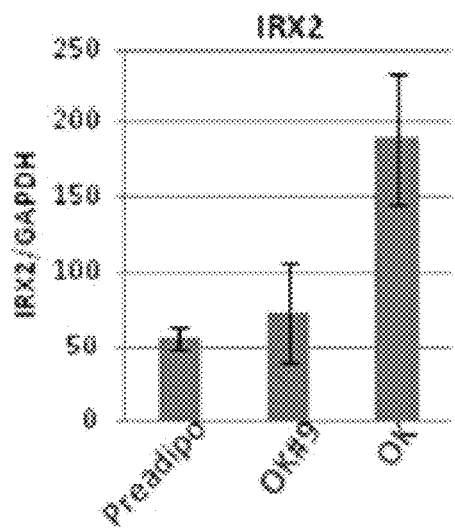
Figure 10C:
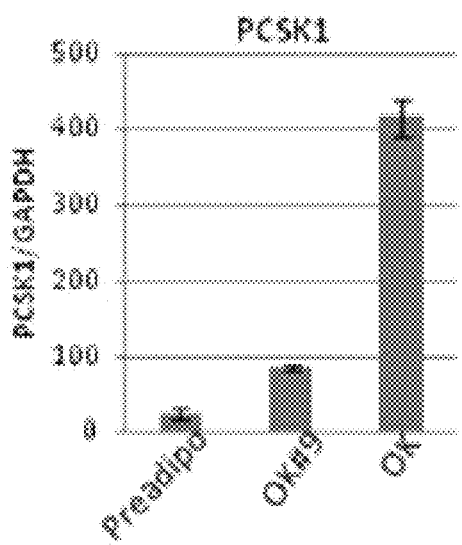
Figure 10D:
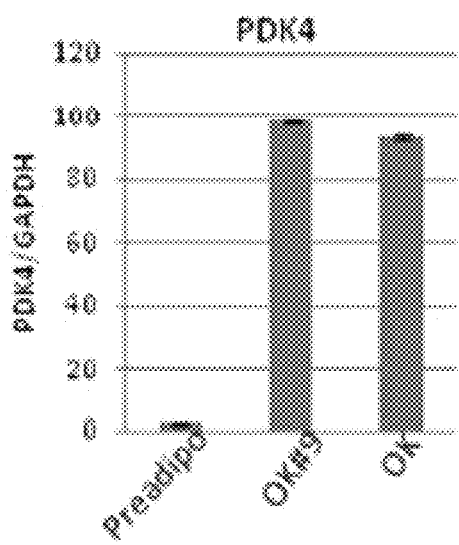
Figure 10E:
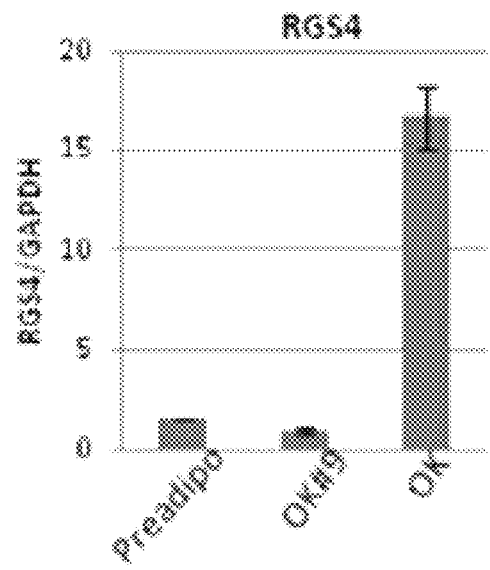
Figure 10F:
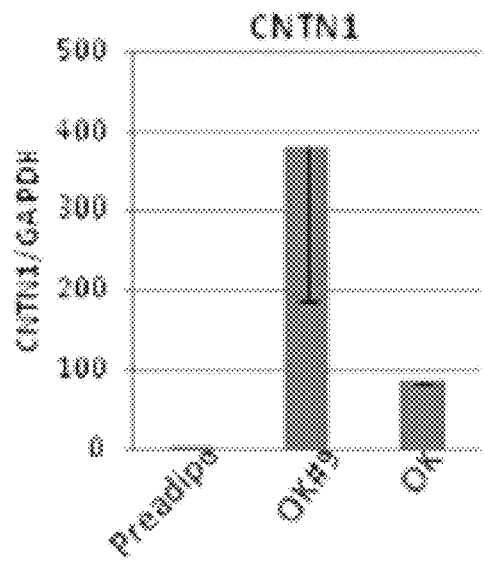
Figure 10G:
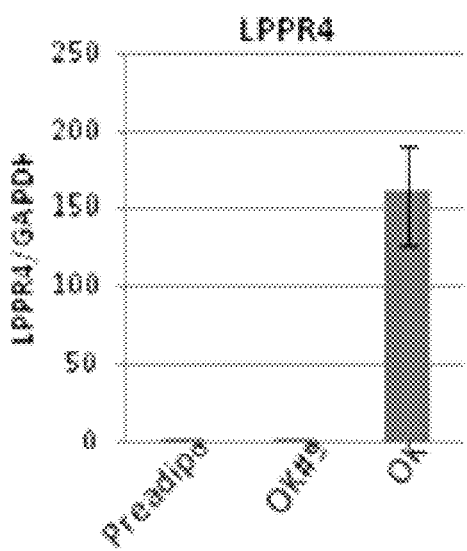
Figure 10H:
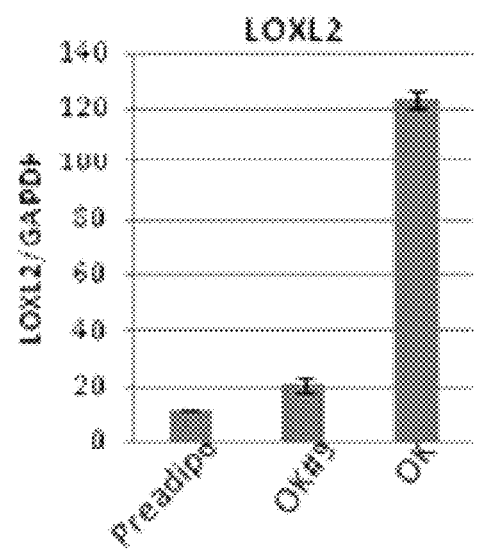
Figure 10I:
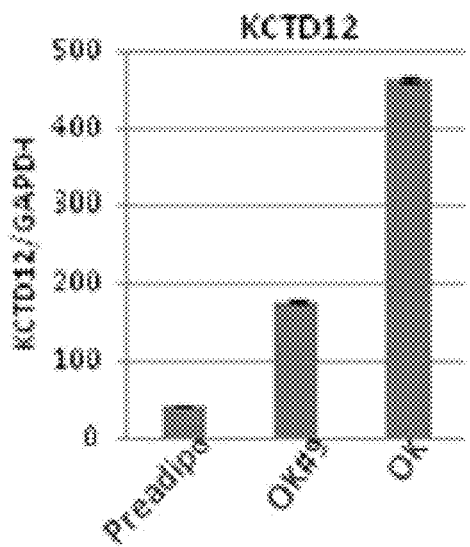
Figure 10J:
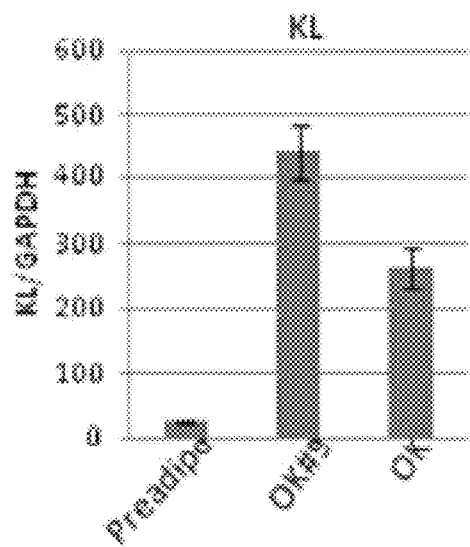
Figure 10K:
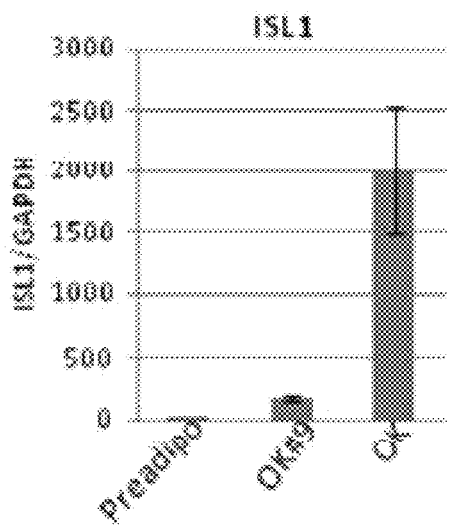
Figure 10L:
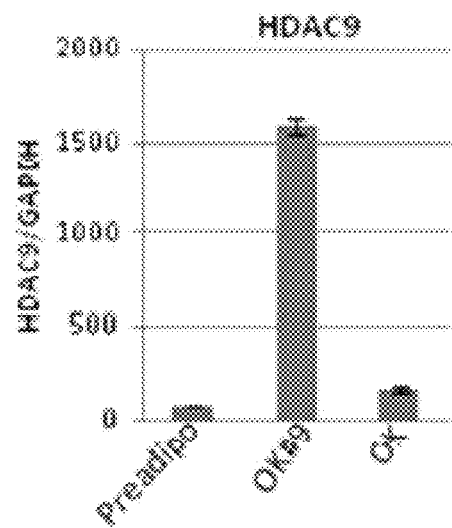
Figure 10M:
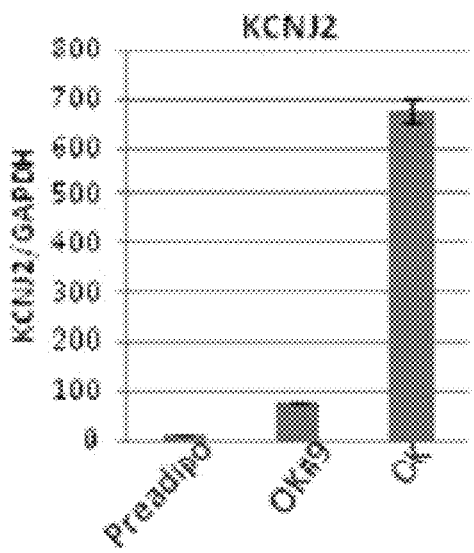
Figure 10N:
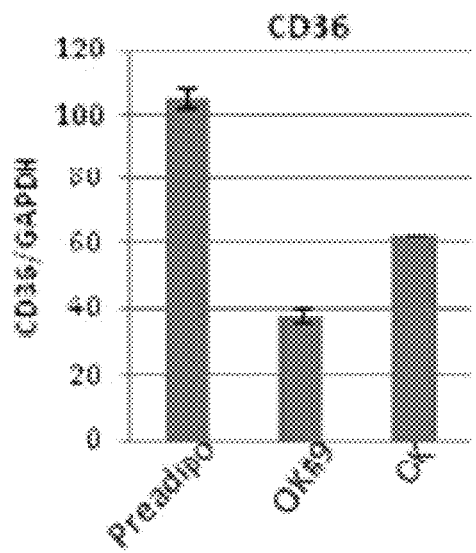
Figure 10:
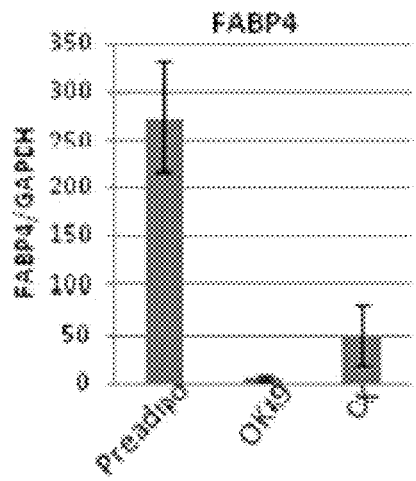
Figure 11:
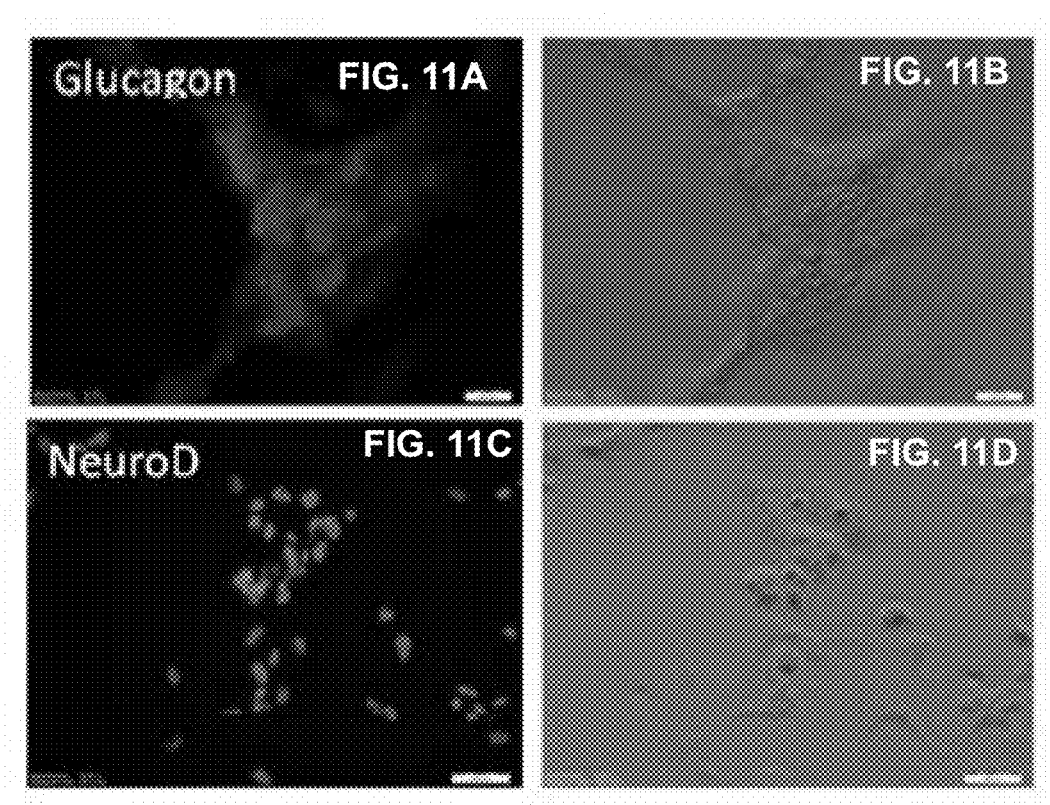
FIGS. 11A-11D show images demonstrating results of immunocytochemistry of transdifferentiated pancreatic alpha cells expressing ectopic Oct4 and Klf4. The Oct4 and Klf4 expressing cells were seeded on matrigel plates and subjected to immunocytochemistry using glucagon (FIGS. 11A and 11B) and NeuroD (FIGS. 11C and 11D) specific antibodies and DAPI nuclear counterstaining.

Pancreatic cell specific gene expression has been confirmed with real-time RTPCR using SYBR green conjugated gene specific primers that show distinct expression patterns across three types of pancreatic cells (α, β and exocrine cells)[26]. As shown in FIGS. 10A-10O, the expression of pancreatic α cell markers (GCG, CNTN1, PCSK1, PDK4, RGS4, IRX2, LPPR4, LOXL2, KCTD12, KL) and β cell markers (ISL1, HDAC9, KCNJ2) were been upregulated dramatically in OK cells while the preadipocyte marker gene (CD36, FABP4) expression decreased (FIGS. 10A-10O). The expression of pancreatic exocrine cell specific markers (AMY1C, AMT1B, AMY1A) were highly expressed in all samples (data not shown). In order to assess glucagon and NeuroD protein expression (a pancreatic α cell product and a pancreatic progenitor marker, respectively), OK cells were seeded onto matrigel coated cell culture plates and cells were examined by immunocytochemistry. The results demonstrate that all of the colonies on matrigel stained with specific antibodies against glucagon or NeuroD except for the feeder cells (FIGS. 11A-11D). To evaluate the secretion of glucagon from the transdifferentiated pancreatic α cells (OK cells, Oct4 alone) using an ELISA from the cell culture supernatants. Although the expression of glucagon from the cell extracts was detected, glucagon secretion was barely detectable. Without being bound by theory, this suggests that pancreatic α cells are missing a component for the glucagon processing and secretion while the cells highly expresses pancreatic exocrine cell markers such as AMY1C, AMT1B, AMY1A.

Figure 14A:
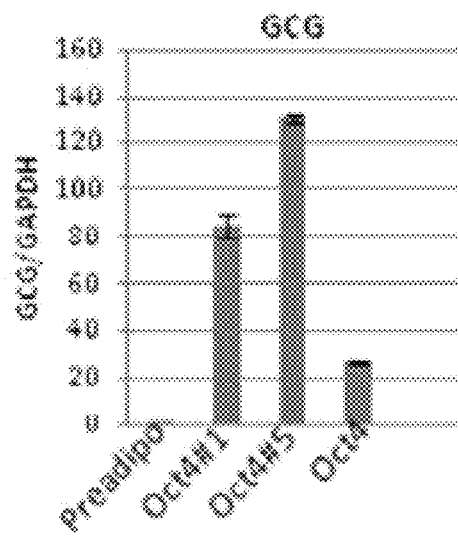
FIGS. 14A-14N show graphs demonstrating gene expression as measured by real-time PCR of GCG (FIG. 14A), KL (FIG. 14B), LPPR4 (FIG. 14C), PDK4 (FIG. 14D), CNTN1 (FIG. 14E), KCTD12 (FIG. 14F), LOXL2 (FIG. 14G), PCSK1 (FIG. 14H), IRX2 (FIG. 14I), ISL1 (FIG. 14J), HDAC9 (FIG. 14K), KCNJ2 (FIG. 14L), CD36 (FIG. 14M), and FABP4 (FIG. 14N) in Oct4 induced pancreatic alpha cells (Oct4#1 and Oct4#5; single clones, Oct4, mixed colonies).
Figure 14B:
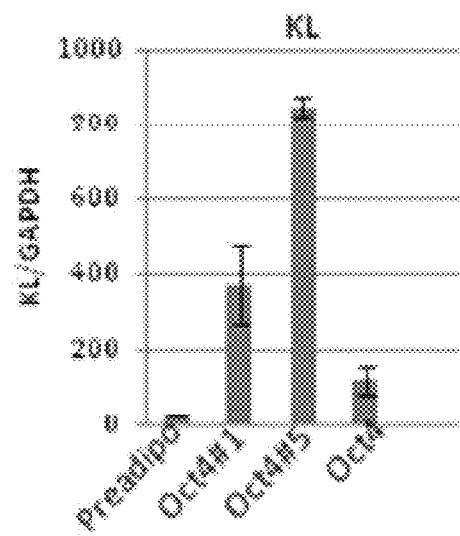
Figure 14C:
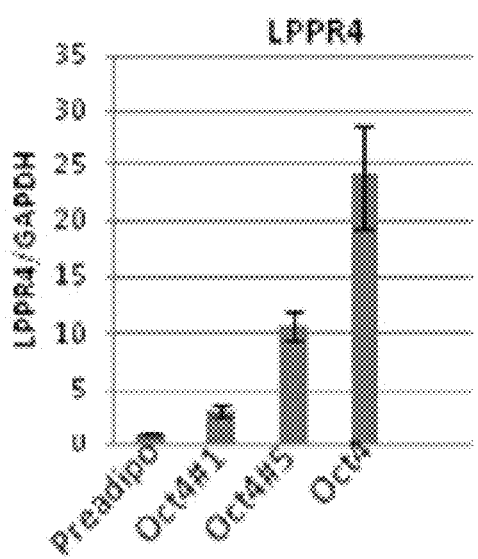
Figure 14D:
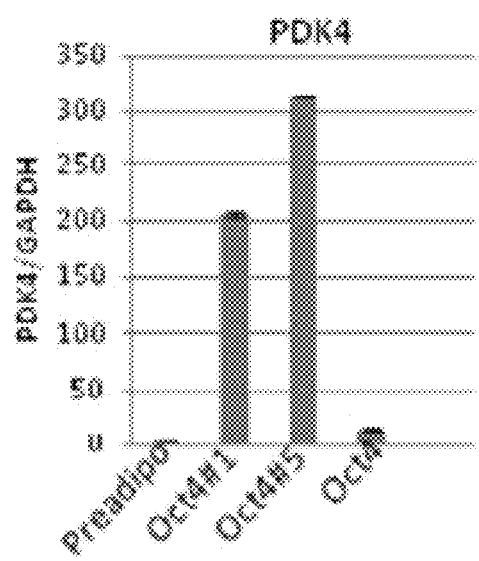
Figure 14E:
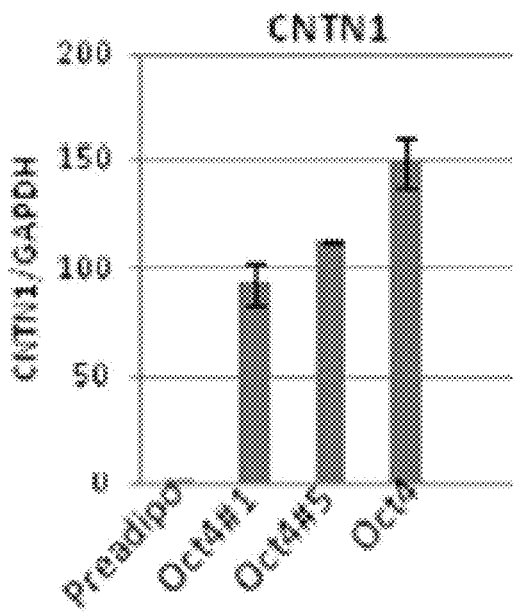
Figure 14F:
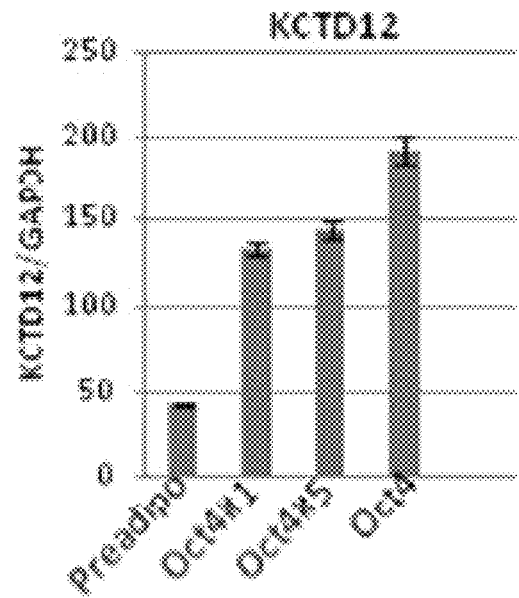
Figure 14G:
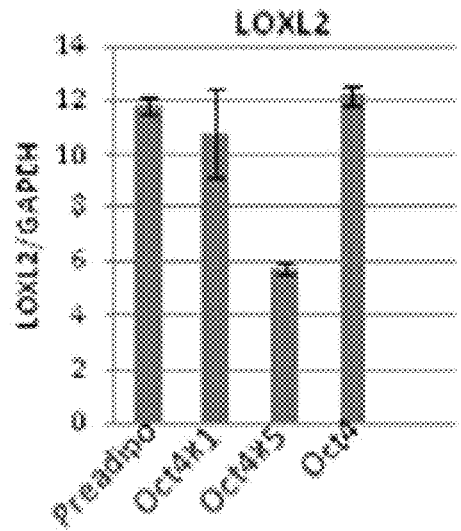
Figure 14H:
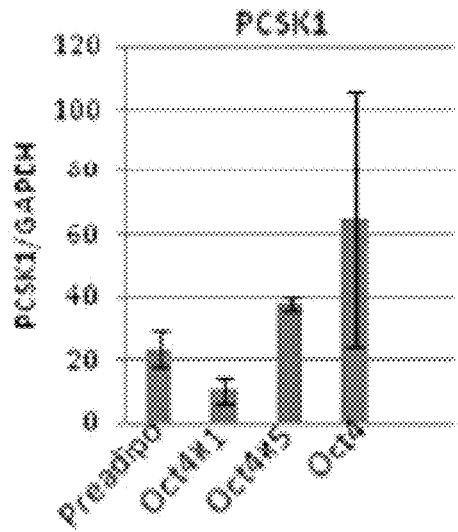
Figure 14I:
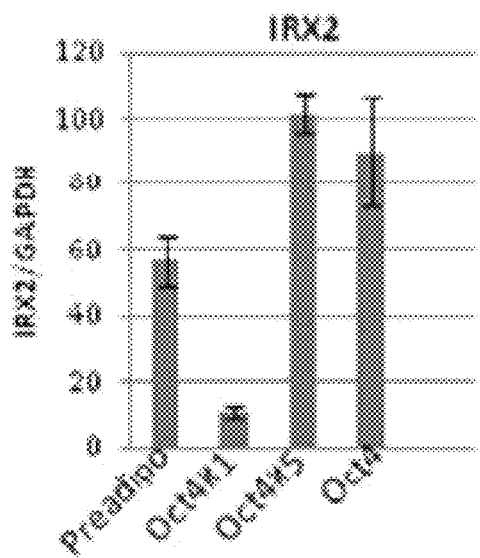
Figure 14J:
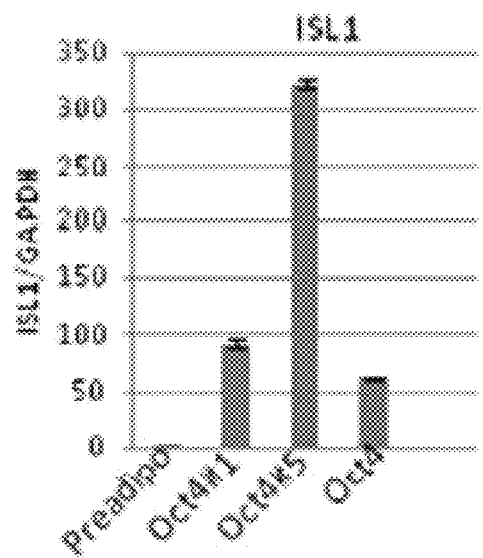
Figure 14K:
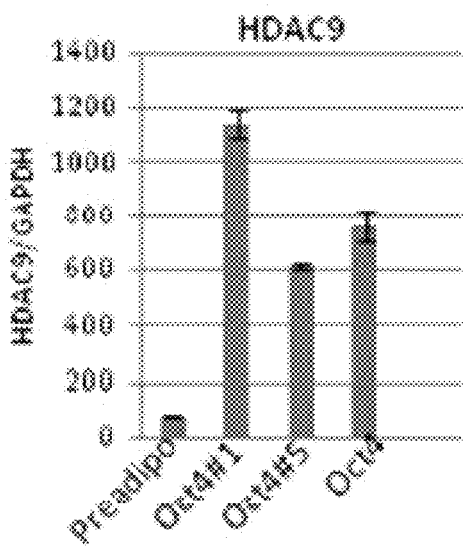
Figure 14L:
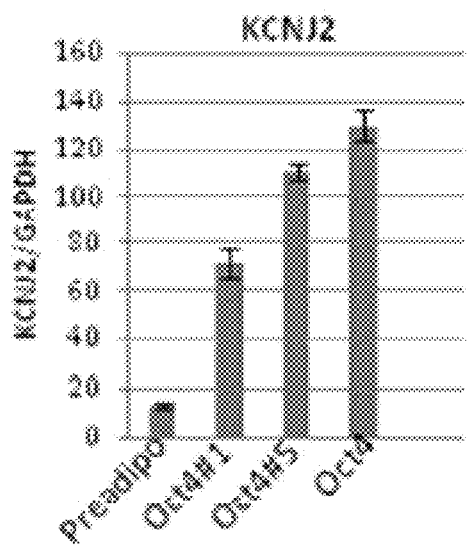
Figure 14M:
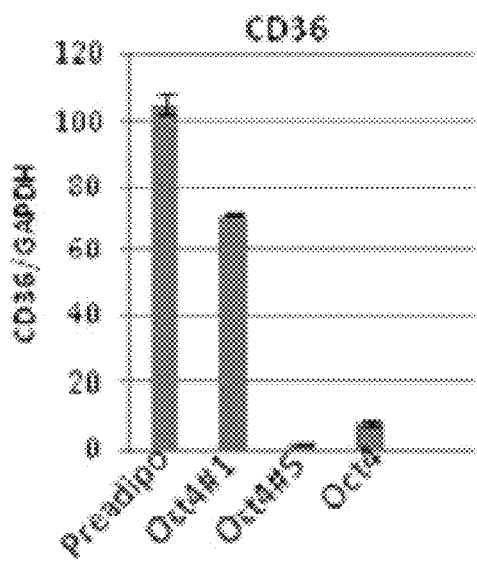
Figure 14N:
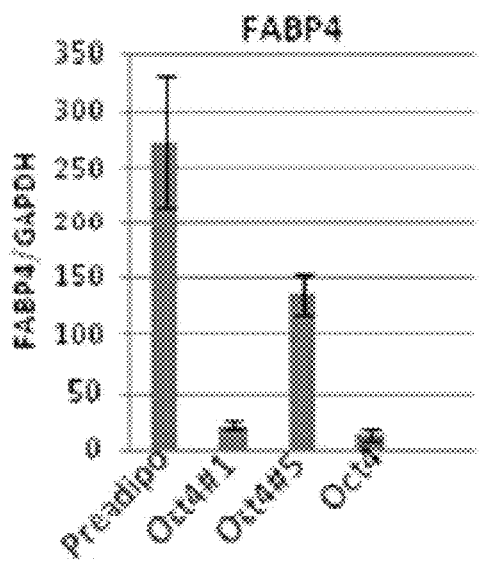

Analysis of the regulatory transcription factor binding sites indicated that the promoter region of most genes that were upregulated in OK cells contain putative POU domain binding sequences, but not Klf4 binding sequences, suggesting Klf4 might be dispensable for the transdifferentiation processes. To test this hypothesis, preadipocytes were transfected with Oct4 only using a lentiviral vector and repeated the experiment using the same conditions used previously. The general outline is shown in FIGS. 12 and 13A-13D. Similar to the previous two factor overexpression, colony formation was observed at 5 days after culturing on feeder cell layer. The cells had virtually identical morphology as the two factor (Oct4, Klf4) induced OK cells (FIGS. 12 and 13A-13D). Next, the pancreatic cell specific gene and protein expression from established colonies (Oct4#1, Oct4#5) and mixed colonies (Oct4) was analyzed. As shown in FIGS. 14A-14N, the expression of pancreatic cell markers from Oct4 single factor overexpressed cells was upregulated at levels similar to two factor (Oct4, Klf4) induced OK cells, except for LOXL2, RGS4 and PCSK1. Glucagon and NeuroD protein expression was confirmed by immunohistochemistry (FIGS. 15A-15D). Without being bound by theory, these results suggest that ectopic expression of Oct4 alone is sufficient to induce transdifferentiation of human preadipocytes into glucagon expressing pancreatic α cells. These results are consistent with previous findings that Oct4 and Nanog play roles in maintaining pluripotency while Klf4 and cMyc regulate cellular division [27].

This Example also indicates that Klf4 is dispensable in the transdifferentiation processes. The Oct4 induced pancreatic α cells was expanded for more than 10 passages without any loss of cellular proliferation properties or pancreatic marker gene expression (data not shown). Glucagon producing pancreatic α cells comprise 0.2-0.5% of pancreatic islets and show great plasticity to become insulin secreting β cells after severe β cell loss in mouse model[28]. Furthermore, Bramswig and colleagues demonstrated that histone methyltransferase inhibitor treatment facilitates the conversion of pancreatic α cell to insulin secreting β cells[26]. These findings regarding the plasticity of adipose stem cells and transdifferentiation into pancreatic endocrine cells and the development of a simple and efficient method to produce pancreatic α cells will provide a model to advance therapeutic strategies for metabolic disease.

Methods

Cell Culture and Lentiviral Transfection.

Human preadipocytes (LaCell, LA) were maintained with Dulbecco's modified Eagle medium (DMEM) supplemented with 10% FBS, 50 U/ml penicillin and 50 µg/ml streptomycin at 37° C., 5% CO2 in a humidified incubator. High titer lentivirus, overexpressing human Oct4, Klf4 or polycistronic lentivirus which express four iPS factors (STEMCCA), was purchased from System Biosciences (San Diego, Calif.), Cellomics (Halethorpe, Md.) and EMD Millipore (Temecula, Calif.). The day before lentiviral transfection, human preadipocytes were trypsinized, counted, and seeded in 6-well plates at a density of $10^5$ cells/well. The next day, culture medium was replaced with pre-warmed medium containing 5 µg/ml polybrene (Sigma-Aldrich) and 25 MOI of lentivirus. Lentiviral infection was repeated the next day, and culture medium was changed with fresh preadipocyte growth medium. When the cells reached confluence, cells were trypsinized, counted and seeded on a prepared MEF feeder layer at a density of $5 \times 10^4$ cells with mTeSR1 medium (StemCell Technology).

Microarray and Gene Expression Analysis. Total RNA was prepared from cultures using Trizol Reagent (Life Technology) and the RNeasy Mini RNA isolation kit (Qiagen, Valencia, Calif.) with DNase I digestion. The RNA quality was verified using an Agilent Bioanalyzer 2100 (Agilent Technologies; Palo Alto, Calif.) using the RNA 6000 Pico Assay. Generation of double-stranded cDNA, preparation and labeling of cRNA, hybridization to HumanHT-12 v4 Expression BeadChip (Illumina, San Diego, Calif.), washing, and scanning were all performed according to the standard Illumina protocol. Quantitative PCR to measure mRNA expression levels was performed with PrimeTime qPCR assays (Integrated DNA Technologies, Coralville, Iowa) using a 7700 real-time PCR system in the genomic core facility at Pennington Biomedical Research Center. Expression levels were compared to known standard samples and were normalized GAPDH.

Immunocytochemistry. Cells were fixed with 4% paraformaldehyde in PBS for 10 min, and incubated for 1 hr with antibodies specific for glucagon and NeuroD1 (Abcam). After washing three times with PBS, cells were incubated for 1 hr with fluorescent conjugated secondary antibody (Invitrogen). Nuclei were detected by DAPI staining (Vector shield).

Abbreviations Used in the Examples
AdiPS=Adipose derived iPS cell
DNMT=DNA methyltransferase
EMT=epithelial-to-mesenchymal transition
ESCs=embryonic stem cells
HDAC=histone deacetylase
HMT=histone methyltransferase
ICM=inner cell mass
iPS cell=induced pluripotent stem cell
MEF=mouse embryonic fibroblasts
OK=Oct4, Klf4
OKSM=Oct4, Klf4, Sox2, cMyc
SVF=stromal vascular fraction

REFERENCES

1. Heyworth C, Pearson S, May G, et al. Transcription factor-mediated lineage switching reveals plasticity in primary committed progenitor cells. *The EMBO journal* 2002; 21(14):3770-3781.
2. Xie H, Ye M, Feng R, et al. Stepwise reprogramming of B cells into macrophages. *Cell* 2004; 117(5):663-676.
3. Kajimura S, Seale P, Kubota K, et al. Initiation of myoblast to brown fat switch by a PRDM16-C/EBP-beta transcriptional complex. *Nature* 2009; 460(7259):1154-1158.
4. Huang P, He Z, Ji S, et al. Induction of functional hepatocyte-like cells from mouse fibroblasts by defined factors. *Nature* 2011; 475(7356):386-389.
5. Buganim Y, Itskovich E, Hu Y C, et al. Direct reprogramming of fibroblasts into embryonic Sertolilike cells by defined factors. *Cell stem cell* 2012; 11(3):373-386.
6. Vierbuchen T, Ostermeier A, Pang Z P, et al. Direct conversion of fibroblasts to functional neurons by defined factors. *Nature* 2010; 463(7284):1035-1041.
7. Kim J, Su S C, Wang H, et al. Functional integration of dopaminergic neurons directly converted from mouse fibroblasts. *Cell stem cell* 2011; 9(5):413-419.
8. Son E Y, Ichida J K, Wainger B J, et al. Conversion of mouse and human fibroblasts into functional spinal motor neurons. *Cell stem cell* 2011; 9(3):205-218.
9. Yang Z, Ming G L, Song H: Postnatal neurogenesis in the human forebrain: from two migratory streams to dribbles. *Cell stem cell* 2011; 9(5):385-386.
10. Takahashi K, Yamanaka S: Induction of pluripotent stem cells from mouse embryonic and adult fibroblast cultures by defined factors. *Cell* 2006; 126(4):663-676.
11. Kim J B, Sebastiano V, Wu G, et al. Oct4-induced pluripotency in adult neural stem cells. *Cell* 2009; 136(3):411-419.

12. Kim E B, Fang X, Fushan A A, et al. Genome sequencing reveals insights into physiology and longevity of the naked mole rat. *Nature* 2011; 479(7372):223-227.
13. Shi Y, Do J T, Desponts C, et al. A combined chemical and genetic approach for the generation of induced pluripotent stem cells. *Cell stem cell* 2008; 2(6):525-528.
14. Tsai S Y, Clavel C, Kim S, et al. Oct4 and klf4 reprogram dermal papilla cells into induced pluripotent stem cells. *Stem Cells* 2010; 28(2):221-228.
15. Liu X, Sun H, Qi J, et al. Sequential introduction of reprogramming factors reveals a timsensitive requirement for individual factors and a sequential EMT-MET mechanism for optimal reprogramming. *Nature cell biology* 2013; 15(7): 829-838.
16. Szabo E, Rampalli S, Risueno R M, et al. Direct conversion of human fibroblasts to multilineage blood progenitors. *Nature* 2010; 468(7323):521-526.
17. Zimmerlin L, Donnenberg V S, Rubin J P, et al. Mesenchymal markers on human adipose stem/progenitor cells. *Cytometry Part A: the journal of the International Society for Analytical Cytology* 2013; 83(1):134-140.
18. Shi Y, Desponts C, Do J T, et al. Induction of pluripotent stem cells from mouse embryonic fibroblasts by Oct4 and Klf4 with small-molecule compounds. *Cell stem cell* 2008; 3(5):568-574.
19. Huangfu D, Maehr R, Guo W, et al. Induction of pluripotent stem cells by defined factors is greatly improved by small-molecule compounds. *Nature biotechnology* 2008; 26(7):795-797.
20. Mikkelsen T S, Hanna J, Zhang X, et al. Dissecting direct reprogramming through integrative genomic analysis. *Nature* 2008; 454(7200):49-55.
21. Kim J, Efe J A, Zhu S, et al. Direct reprogramming of mouse fibroblasts to neural progenitors. *Proceedings of the National Academy of Sciences of the United States of America* 2011; 108(19):7838-7843.
22. Yang L, Li S, Hatch H, et al. In vitro trans-differentiation of adult hepatic stem cells into pancreatic endocrine hormone-producing cells. *Proceedings of the National Academy of Sciences of the United States of America* 2002; 99(12):8078-8083.
23. Gradwohl G, Dierich A, LeMeur M, et al. neurogenin3 is required for the development of the four endocrine cell lineages of the pancreas. *Proceedings of the National Academy of Sciences of the United States of America* 2000; 97(4):1607-1611.
24. Meivar-Levy I, Sapir T, Gefen-Halevi S, et al. Pancreatic and duodenal homeobox gene 1 induces hepatic dedifferentiation by suppressing the expression of CCAAT/enhancer-binding protein beta. *Hepatology* 2007; 46(3):898-905.
25. Kataoka K, Han S I, Shioda S, et al. MafA is a glucose-regulated and pancreatic beta-cell-specific transcriptional activator for the insulin gene. *The Journal of biological chemistry* 2002; 277(51):49903-49910.
26. Bramswig N C, Everett L J, Schug J, et al. Epigenomic plasticity enables human pancreatic alpha to beta cell reprogramming. *The Journal of clinical investigation* 2013; 123(3):1275-1284.
27. McConnell B B, Yang V W: Mammalian Kruppel-like factors in health and diseases. *Physiological reviews* 2010; 90(4): 1337-1381.
28. Thorel F, Nepote V, Avril I, et al. Conversion of adult pancreatic alpha-cells to beta-cells after extreme beta-cell loss. *Nature* 2010; 464(7292):1149-1154.
29. Jacobsen J P, Weikop P, Hansen H H, et al. SK3 K+ channel-deficient mice have enhanced dopamine and serotonin release and altered emotional behaviors. *Genes, brain, and behavior* 2008; 7(8):836-848.

TABLE 1

| SEQ ID NO | GenBank Accession Number | Gene Name |
|---|---|---|
| 1 | NM_203289 | OCT4 |
| 2 | NM_001173531 | OCT4 |
| 3 | NM_001285986 | OCT4 |
| 4 | NM_001285987.1 | OCT4 |
| 5 | NM_002701 | OCT4 |
| 6 | NM_001252452 | OCT4 |
| 7 | NM_013633 | OCT4 |
| 8 | NP_001272916.1 | OCT4 |
| 9 | NP_002692.2 | OCT4 |
| 10 | NP_001272915.1 | OCT4 |
| 11 | NP_038661.2 | OCT4 |
| 12 | NM_001314052 | Klf4 |
| 13 | NM_010637 | Klf4 |
| 14 | NP_004226.3 | Klf4 |
| 15 | NP_001300981.1 | Klf4 |
| 16 | NP_034767.2 | Klf4 |
| 17 | NM_003106 | Sox2 |
| 18 | NM_011443 | Sox2 |
| 19 | NP_003097.1 | Sox2 |
| 20 | NP_035573.3 | Sox2 |
| 21 | NM_002467 | cMyc |
| 22 | NM_001177352 | cMyc |
| 23 | NM_001177353 | cMyc |
| 24 | NM_001177354 | cMyc |
| 25 | NM_010849 | cMyc |
| 26 | NP_002458.2 | cMyc |
| 27 | NP_001170823.1 | cMyc |
| 28 | NP_001170824.1 | cMyc |
| 29 | NP_001170825.1 | cMyc |
| 30 | NM_001256063 | CNTN1 |
| 31 | NM_001256064 | CNTN1 |
| 32 | NM_001843 | CNTN1 |
| 33 | NM_175038 | CNTN1 |
| 34 | NM_001159647 | CNTN1 |
| 35 | NM_001159648 | CNTN1 |
| 36 | NP_001242992.1 | CNTN1 |
| 37 | NP_001242993.1 | CNTN1 |
| 38 | NP_001834.2 | CNTN1 |
| 39 | NP_778203.1 | CNTN1 |
| 40 | NP_001153119.1 | CNTN1 |
| 41 | NP_001153120.1 | CNTN1 |
| 42 | NP_031753.1 | CNTN1 |
| 43 | NM_001177876.1 | PCSK1 |
| 44 | NM_000439 | PCSK1 |
| 45 | NM_001177875 | PCSK1 |
| 46 | NM_013628 | PCSK1 |
| 47 | NP_000430.3 | PCSK1 |
| 48 | NP_001171346.1 | PCSK1 |
| 49 | NP_038656.1 | PCSK1 |
| 50 | NM_002612 | PDK4 |
| 51 | NP_002603.1 | PDK4 |
| 52 | NM_001102445 | RGS4 |
| 53 | NM_001113380 | RGS4 |
| 54 | NM_001113381 | RGS4 |
| 55 | NM_005613 | RGS4 |
| 56 | NM_009062 | RGS4 |
| 57 | NP_001095915.1 | RGS4 |
| 58 | NP_001106851.1 | RGS4 |
| 59 | NP_001106582.1 | RGS4 |
| 60 | NP_005604.1 | RGS4 |
| 61 | NP_033088.2 | RGS4 |
| 62 | NM_001134222.1 | IRX2 |
| 63 | NM_033267.4 | IRX2 |
| 64 | NM_010574 | IRX2 |
| 65 | NP_001127694.1 | IRX2 |
| 66 | NP_150366.1 | IRX2 |
| 67 | NP_034704.1 | IRX2 |
| 68 | NM_001166252.1 | LPPR4 |
| 69 | NM_014839.4 | LPPR4 |
| 70 | NP_001159724.1 | LPPR4 |
| 71 | NP_055654.2 | LPPR4 |
| 72 | NM_002318.2 | LOXL2 |
| 73 | NP_002309.1 | LOXL2 |

TABLE 1-continued

| SEQ ID NO | GenBank Accession Number | Gene Name |
|---|---|---|
| 74 | NM_032211.6 | LOXL4 |
| 75 | NP_115587.6 | LOXL4 |
| 76 | NM_138444.3 | KCTD12 |
| 77 | NP_612453.1 | KCTD12 |
| 78 | NM_004795.3 | KL |
| 79 | NP_004786.2 | KL |
| 80 | NM_005349.3 | RBPJ |
| 81 | NM_015874.4 | RBPJ |
| 82 | NM_203283.2 | RBPJ |
| 83 | NM_203284.2 | RBPJ |
| 84 | NP_005340.2 | RBPJ |
| 85 | NP_056958.3 | RBPJ |
| 86 | NP_976028.1 | RBPJ |
| 87 | NP_976029.1 | RBPJ |
| 88 | NM_000346.3 | Sox9 |
| 89 | NP_000337.1 | Sox9 |
| 90 | NM_002500.4 | NeuroD |
| 91 | NP_002491.2 | NeuroD |
| 92 | NM_002202.2 | ISL1 |
| 93 | NP_002193.2 | ISL1 |
| 94 | NM_002923.3 | RGS2 |
| 95 | NP_002914.1 | RGS2 |
| 96 | NM_000584.3 | IL8 |
| 97 | NP_000575.1 | IL8 |
| 98 | NM_004842.3 | AKAP7 |
| 99 | NM_016377.3 | AKAP7 |
| 100 | NM_138633.2 | AKAP7 |
| 101 | NP_004833.1 | AKAP7 |
| 102 | NP_057461.2 | AKAP7 |
| 103 | NP_619539.1 | AKAP7 |
| 104 | NM_001873.3 | CPE |
| 105 | NP_001864.1 | CPE |
| 106 | NM_001032409.2 | OAS1 |
| 107 | NM_001320151.1 | OAS1 |
| 108 | NM_002534.3 | OAS1 |
| 109 | NM_016816.3 | OAS1 |
| 110 | NP_001027581.1 | OAS1 |
| 111 | NP_001307080.1 | OAS1 |
| 112 | NP_002525.2 | OAS1 |
| 113 | NP_058132.2 | OAS1 |
| 114 | NM_001242920.1 | PLTP |
| 115 | NM_001242921.1 | PLTP |
| 116 | NM_006227.3 | PLTP |
| 117 | NM_182676.2 | PLTP |
| 118 | NP_001229849.1 | PLTP |
| 119 | NP_001229850.1 | PLTP |
| 120 | NP_006218.1 | PLTP |
| 121 | NP_872617.1 | PLTP |
| 122 | NM_001199017.2 | PGS4 |
| 123 | NM_001199018.2 | PGS4 |
| 124 | NM_001284357.1 | PGS4 |
| 125 | NM_017691.4 | PGS4 |
| 126 | NP_001185946.1 | PGS4 |
| 127 | NP_001185947.1 | PGS4 |
| 128 | NP_001271286.1 | PGS4 |
| 129 | NP_060161.2 | PGS4 |
| 130 | NM_024539.3 | RNF128 |
| 131 | NM_194463.1 | RNF128 |
| 132 | NP_078815.3 | RNF128 |
| 133 | NP_919445.1 | RNF128 |
| 134 | NM_018476.3 | BEX1 |
| 135 | NP_060946.3 | BEX1 |
| 136 | NM_001204144.2 | HDAC9 |
| 137 | NM_001204145.2 | HDAC9 |
| 138 | NM_001204146.2 | HDAC9 |
| 139 | NM_001204147.2 | HDAC9 |
| 140 | NM_001204148.2 | HDAC9 |
| 141 | NP_001191073.1 | HDAC9 |
| 142 | NP_001191074.1 | HDAC9 |
| 143 | NP_001191075.1 | HDAC9 |
| 144 | NP_001191076.1 | HDAC9 |
| 145 | NP_001191077.1 | HDAC9 |
| 146 | NP_001308797.1 | HDAC9 |
| 147 | NP_001308798.1 | HDAC9 |
| 148 | NP_001308799.1 | HDAC9 |
| 149 | NP_001308800.1 | HDAC9 |
| 150 | NP_001308801.1 | HDAC9 |
| 151 | NP_001308802.1 | HDAC9 |
| 152 | NP_001308803.1 | HDAC9 |
| 153 | NP_001308804.1 | HDAC9 |
| 154 | NP_001308805.1 | HDAC9 |
| 155 | NP_001308806.1 | HDAC9 |
| 156 | NP_001308807.1 | HDAC9 |
| 157 | NP_001308808.1 | HDAC9 |
| 158 | NP_001308813.1 | HDAC9 |
| 159 | NP_001308814.1 | HDAC9 |
| 160 | NP_001308815.1 | HDAC9 |
| 161 | NP_001308816.1 | HDAC9 |
| 162 | NP_001308817.1 | HDAC9 |
| 163 | NP_001308818.1 | HDAC9 |
| 164 | NP_001308819.1 | HDAC9 |
| 165 | NP_001308820.1 | HDAC9 |
| 166 | NP_001308822.1 | HDAC9 |
| 167 | NP_001308823.1 | HDAC9 |
| 168 | NP_001308824.1 | HDAC9 |
| 169 | NP_001308825.1 | HDAC9 |
| 170 | NP_001308826.1 | HDAC9 |
| 171 | NP_001308827.1 | HDAC9 |
| 172 | NP_001308828.1 | HDAC9 |
| 173 | NP_001308829.1 | HDAC9 |
| 174 | NP_001308830.1 | HDAC9 |
| 175 | NP_001308831.1 | HDAC9 |
| 176 | NP_055522.1 | HDAC9 |
| 177 | NP_478056.1 | HDAC9 |
| 178 | NP_848510.1 | HDAC9 |
| 179 | NP_848512.1 | HDAC9 |
| 180 | NM_000891.2 | KCNJ2 |
| 181 | NP_000882.1 | KCNJ2 |
| 182 | NM_000072.3 | CD36 |
| 183 | NM_001001547.2 | CD36 |
| 184 | NM_001001548.2 | CD36 |
| 185 | NM_001127443.1 | CD36 |
| 186 | NM_001127444.1 | CD36 |
| 187 | NM_001289908.1 | CD36 |
| 188 | NM_001289909.1 | CD36 |
| 189 | NM_001289911.1 | CD36 |
| 190 | NP_000063.2 | CD36 |
| 191 | NP_001001547.1 | CD36 |
| 192 | NP_001001548.1 | CD36 |
| 193 | NP_001120915.1 | CD36 |
| 194 | NP_001120916.1 | CD36 |
| 195 | NP_001276837.1 | CD36 |
| 196 | NP_001276838.1 | CD36 |
| 197 | NP_001276840.1 | CD36 |
| 198 | NM_001442.2 | FABP4 |
| 199 | NP_001433.1 | FABP4 |
| 200 | NM_001128148.2 | CD71 |
| 201 | NM_001313965.1 | CD71 |
| 202 | NM_001313966.1 | CD71 |
| 203 | NM_003234.3 | CD71 |
| 204 | NP_001121620.1 | CD71 |
| 205 | NP_001300894.1 | CD71 |
| 206 | NP_001300895.1 | CD71 |
| 207 | NP_003225.2 | CD71 |
| 208 | NM_004267.4 | CHST2 |
| 209 | NP_004258.2 | CHST2 |
| 210 | NM_000480.2 | AMPD3 |
| 211 | NM_001025389.1 | AMPD3 |
| 212 | NM_001025390.1 | AMPD3 |
| 213 | NM_001172430.1 | AMPD3 |
| 214 | NM_001172431.1 | AMPD3 |
| 215 | NP_000471.1 | AMPD3 |
| 216 | NP_001020560.1 | AMPD3 |
| 217 | NP_001020561.1 | AMPD3 |
| 218 | NP_001165901.1 | AMPD3 |
| 219 | NP_001165902.1 | AMPD3 |
| 220 | NM_001144822.1 | CD58 |
| 221 | NM_001779.2 | CD58 |
| 222 | NP_001138294.1 | CD58 |
| 223 | NP_001770.1 | CD58 |
| 224 | NM_001178117.1 | MINPP1 |
| 225 | NM_001178118.1 | MINPP1 |
| 226 | NM_004897.4 | MINPP1 |
| 227 | NP_001171588.1 | MINPP1 |

TABLE 1-continued

| SEQ ID NO | GenBank Accession Number | Gene Name |
|---|---|---|
| 228 | NP_001171589.1 | MINPP1 |
| 229 | NP_004888.2 | MINPP1 |
| 230 | NM_001289910.1 | IDH2 |
| 231 | NM_001290114.1 | IDH2 |
| 232 | NM_002168.3 | IDH2 |
| 233 | NP_001276839.1 | IDH2 |
| 234 | NP_001277043.1 | IDH2 |
| 235 | NP_002159.2 | IDH2 |
| 236 | NM_001252.4 | CD70 |
| 237 | NP_001243.1 | CD70 |
| 238 | NM_019111.4 | HLA-DRA |
| 239 | NP_061984.2 | HLA-DRA |
| 240 | NM_001135659.2 | NX1 |
| 241 | NM_001320156.2 | NX1 |
| 242 | NM_001320157.3 | NX1 |
| 243 | NM_004801.5 | NX1 |
| 244 | NM_138735.4 | NX1 |
| 245 | NP_001129131.1 | NX1 |
| 246 | NP_001307085.1 | NX1 |
| 247 | NP_001307086.1 | NX1 |
| 248 | NP_004792.1 | NX1 |
| 249 | NP_620072.1 | NX1 |
| 250 | NM_001040280.1 | CD83 |
| 251 | NM_001251901.1 | CD83 |
| 252 | NM_004233.3 | CD83 |
| 253 | NP_001035370.1 | CD83 |
| 254 | NP_001238830.1 | CD83 |
| 255 | NP_004224.1 | CD83 |
| 256 | NM_001025158.2 | CD74 |
| 257 | NM_001025159.2 | CD74 |
| 258 | NM_004355.3 | CD74 |
| 259 | NP_001020329.1 | CD74 |
| 260 | NP_001020330.1 | CD74 |
| 261 | NP_004346.1 | CD74 |
| 262 | NM_006820.3 | IFI44L |
| 263 | NP_006811.2 | IFI44L |
| 264 | NM_004335.3 | BST2 |
| 265 | NP_004326.1 | BST2 |
| 266 | NM_005101.3 | ISG15 |
| 267 | NP_005092.1 | ISG15 |
| 268 | NM_001317009.1 | CLIC6 |
| 269 | NM_053277.2 | CLIC6 |
| 270 | NP_001303938.1 | CLIC6 |
| 271 | NP_444507.1 | CLIC6 |
| 272 | NM_001134778.1 | PBX3 |
| 273 | NM_006195.5 | PBX3 |
| 274 | NP_001128250.1 | PBX3 |
| 275 | NP_006186.1 | PBX3 |
| 276 | NM_001098796.1 | TOX2 |
| 277 | NM_001098797.1 | TOX2 |
| 278 | NM_001098798.1 | TOX2 |
| 279 | NM_032883.2 | TOX2 |
| 280 | NP_001092266.1 | TOX2 |
| 281 | NP_001092267.1 | TOX2 |
| 282 | NP_001092268.1 | TOX2 |
| 283 | NP_116272.1 | TOX2 |
| 284 | NR_040662.1 | HCP5 |
| 285 | NM_002872.4 | RAC2 |
| 286 | NP_002863.1 | RAC2 |
| 287 | NM_002922.3 | RGS1 |
| 288 | NP_002913.3 | RGS1 |
| 289 | NM_001243835.1 | STAT4 |
| 290 | NM_003151.3 | STAT4 |
| 291 | NP_001230764.1 | STAT4 |
| 292 | NP_003142.1 | STAT4 |
| 293 | NM_002118.4 | HLA-DMB |
| 294 | NP_002109.2 | HLA-DMB |
| 295 | NM_001204813.1 | NT5E |
| 296 | NM_002526.3 | NT5E |
| 297 | NP_001191742.1 | NT5E |
| 298 | NP_002517.1 | NT5E |
| 299 | NM_001731.2 | BTG1 |
| 300 | NP_001722.1 | BTG1 |
| 301 | NM_000591.3 | CD14 |
| 302 | NP_000582.1 | CD14 |
| 303 | NM_000129.3 | F13A1 |
| 304 | NP_000120.2 | F13A1 |
| 305 | NM_006682.2 | FGL2 |
| 306 | NP_006673.1 | FGL2 |
| 307 | NM_000804.3 | FOLR3 |
| 308 | NP_000795.2 | FOLR3 |
| 309 | NM_001144925.2 | MX1 |
| 310 | NP_001138397.1 | MX1 |
| 311 | NM_172341.2 | PSENEN |
| 312 | NP_758844.1 | PSENEN |
| 313 | NM_002038.3 | IFI6 |
| 314 | NP_002029.3 | IFI6 |
| 315 | NM_006043.1 | HS3ST2 |
| 316 | NP_006034.1 | HS3ST2 |
| 317 | NM_013259.2 | TAGLN3 |
| 318 | NP_037391.2 | TAGLN3 |
| 319 | NM_014848.6 | SV2B |
| 320 | NP_055663.1 | SV2B |
| 321 | NM_001040624.1 | NCALD |
| 322 | NP_001035714.1 | NCALD |
| 322 | NP_001035714.1 | NCALD |
| 323 | NM_003633.3 | ENC1 |
| 324 | NP_003624.1 | ENC1 |
| 325 | NM_001287436.1 | COBL |
| 326 | NP_001274365.1 | COBL |
| 327 | NM_001958.3 | EEF1A2 |
| 328 | NP_001949.1 | EEF1A2 |
| 329 | NM_001958.3 | KBTBD11 |
| 330 | NP_055682.1 | KBTBD11 |
| 331 | NM_015149.4 | RGL1 |
| 332 | NP_055964.3 | RGL1 |
| 333 | NM_001217.4 | CA11 |
| 334 | NP_001208.2 | CA11 |
| 335 | NM_018092.4 | NETO2 |
| 336 | NP_060562.3 | NETO2 |
| 337 | NM_018431.4 | DOK5 |
| 338 | NP_060901.2 | DOK5 |
| 339 | NM_178012.4 | TUBB2B |
| 340 | NP_821080.1 | TUBB2B |
| 341 | NM_001105243.1 | PCDH19 |
| 342 | NP_001098713.1 | PCDH19 |
| 343 | NM_030667.2 | PTPRO |
| 344 | NP_109592.1 | PTPRO |
| 345 | NM_001172509.1 | SATB2 |
| 346 | NP_001165980.1 | SATB2 |
| 347 | NM_004114.3 | FGF13 |
| 348 | NP_004105.1 | FGF13 |
| 349 | NM_001338.4 | CXADR |
| 350 | NP_001329.1 | CXADR |
| 351 | NM_006818.3 | MLLT11 |
| 352 | NP_006809.1 | MLLT11 |
| 353 | NM_016192.3 | TMEFF2 |
| 354 | NP_057276.2 | TMEFF2 |
| 355 | NM_032430.1 | BRSK1 |
| 356 | NP_115806.1 | BRSK1 |
| 357 | NM_006176.2 | NRGN |
| 358 | NP_006167.1 | NRGN |
| 359 | NM_003182.2 | TAC1 |
| 360 | NP_003173.1 | TAC1 |
| 361 | NM_006727.4 | CDH10 |
| 362 | NP_006718.2 | CDH10 |
| 363 | NM_003287.3 | TPD52L1 |
| 364 | NP_003278.1 | TPD52L1 |
| 365 | NM_003528.2 | HIST2H2BE |
| 366 | NP_003519.1 | HIST2H2BE |
| 367 | NM_194298.2 | SLC16A9 |
| 368 | NP_919274.1 | SLC16A9 |
| 369 | NM_032446.2 | MEGF10 |
| 370 | NP_115822.1 | MEGF10 |
| 371 | NM_052905.3 | FMNL2 |
| 372 | NP_443137.2 | FMNL2 |
| 373 | NM_001127211.2 | KIAA1598 |
| 374 | NP_001120683.1 | KIAA1598 |
| 375 | NM_139072.3 | DNER |
| 376 | NP_620711.3 | DNER |
| 377 | NM_000216.3 | KAL1 |
| 378 | NP_000207.2 | KAL1 |
| 379 | NM_002838.4 | CD45 |
| 380 | NP_002829.3 | CD45 |

TABLE 1-continued

| SEQ ID NO | GenBank Accession Number | Gene Name |
|---|---|---|
| 381 | NM_001008219.1 | AMY1C |
| 382 | NP_001008220.1 | AMY1C |
| 383 | NM_004038.3 | AMY1A |
| 384 | NP_004029.2 | AMY1A |
| 385 | NM_002054.4 | GCG |
| 386 | NP_002045.1 | GCG |
| 387 | NM_005195.3 | CEBPD |

TABLE 1-continued

| SEQ ID NO | GenBank Accession Number | Gene Name |
|---|---|---|
| 388 | NP_005186.2 | CEBPD |
| 389 | NM_182915.2 | STEAP3 |
| 390 | NP_878919.2 | STEAP3 |
| 391 | XM_001692619.1 | AMT1B |
| 392 | XM_001692619.1 | AMT1B |

SEQUENCE LISTING (392 sequences)

SEQ ID NO: 1 - DNA, 2075 bp, Artificial Sequence
  OCT4
ggaaaaaaggaaagtgcacttggaagagatccaagtgggcaacttgaagaacaagtgccaaatagcacttctgtcatgctggatgtcagggctctttgtccactttgtatagccgctggcttatagaaggtgctcgataaatctcttgaatttaaaaatcaattaggatgcctctatagtgaaaaagatacagtaaagatgagggataatcaatttaaaaaatgagtaagtacacacaaagcactttatccattcttatgacacctgttacttttttgctgtgtttgtgtgtatgcatgccatgttatagtttgtgggaccctcaaagcaagctggggagagtatatactgaatttagcttctgagacatgatgctcttcctttttaattaacccagaacttagcagcttatctatttctctaatctcaaaacatccttaaactgggggtgatacttgagtgagagaattttgcaggtattaaatgaactatcttcttttttttttttctttgagacagagtcttgctctgtcacccaggctggagtgcagtggcgtgatctcagctcactgcaacctccgcctcccgggttcaagtgattctcctgcctcagcctcctgagtagctgggattacaggtgcgtgccaccgtgcccagctaatttttgtgtttttagtagagacggggtttcaccatgttggccatgctggtcttgaactcctgacctcgtgatctgcccacctcggcctcccaaagtgctggaattataggcgtgagccaccgcgcccagcaaagaacttctaaccttcataacctgacaggtgttctcgaggccagggtctctctttctgtcctttcacgatgctctgcatcccttggatgtgccagtttctgggggaagagtagtcctttgttacatgcatgagtcagtgaacagggaatgggtgaatgacatttgtgggtaggttatttctagaagttaggtgggcagcttggaaggcagaggcacttctacagactattccttggggccacacgtaggttcttgaatcccgaatggaaaggggagattgataactggtgtgtttatgttcttacaagtcttctgccttttaaaatccagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacacttaaaaaaaaaaa

SEQ ID NO: 2 - DNA, 1589 bp, Artificial Sequence
  OCT4
ggaaaaaaggaaagtgcacttggaagagatccaagtgggcaacttgaagaacaagtgccaaatagcacttctgtcatgctggatgtcagggctctttgtccactttgtatagccgctggcttatagaaggtgctcgataaatctcttgaatttaaaaatcaattaggatgcctctatagtgaaaaagatacagtaaagatgagggataatcaatttaaaaaatgagtaagtacacacaaagcactttatccattcttatgacacctgttacttttttgctgtgtttgtgtgtatgcatgccatgttatagtttgtgggaccctcaaagcaagctggggagagtatatactgaatttagcttctgagacatgatgctcttcctttttaattaacccagaacttagcagcttatctatttctctaatctcaaaacatccttaaactgggggtgatacttgagtgagagaattttgcaggtattaaatgaactatcttcttttttttttttctttgagacagagtcttgctctgtcacccaggctggagtgcagtggcgtgatctcagctcactgcaacctccgcctcccgggttcaagtgattctcctgcctcagcctcctgagtagctgggattacagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacacttaaaaaaaaaaa

SEQ ID NO: 3 - DNA, 2300 bp, Artificial Sequence
  OCT4
ggaaaaaaggaaagtgcacttggaagagatccaagtgggcaacttgaagaacaagtgccaaatagcacttctgtcatgctggatgtcagggctctttgtccactttgtatagccgctggcttatagaaggtgctcgataaatctcttgaatttaaaaatcaattaggatgcctctatagtgaaaaagatacagtaaagatgagggataatcaatttaaaaaatgagtaagtacacacaaagcactttatccattcttatgacacctgttacttttttgctgtgtttgtgtgtatgcatgccatgttatagtttgtgggaccctcaaagcaagctggggagagtatatactgaatttagcttctgagacatgatgctcttcctttttaattaacccagaacttagcagcttatctatttctctaatctcaaaacatccttaaactgggggtgatacttgagtgagagaattttgcaggtattaaatgaactatcttcttttttttttttctttgagacagagtcttgctctgtcacccaggctggagtgcagtggcgtgatctcagctcactgcaacctccgcctcccgggttcaagtgattctcctgcctcagcctcctgagtagctgggattacaggtgcgtgccaccgtgcccagctaatttttgtgtttttagtagagacggggtttcaccatgttggccatgctggtcttgaactcctgacctcgtgatctgcccacctcggcctcccaaagtgctggaattataggcgtgagccaccgcgcccagcaaagaacttctaaccttcataacctgacaggtgttctcgaggccagggtctctctttctgtcctttcacgatgctctgcatcccttggatgtgccagtttctgggggaagagtagtcctttgttacatgcatgagtcagtgaacagggaatgggtgaatgacatttgtgggtaggttatttctagaagttaggtgggcagcttggaaggcagaggcacttctacagactattccttggggccacacgtaggttcttgaatcccgaatggaaaggggagattgataactggtgtgtttatgttcttacaagtcttctgccttttaaaatccagtcccaggacatcaaagctctgcagaaagaactcgagcaatttgccaagctcctgaagcagaagaggatcaccctgggatatacacaggccgatgtggggctcaccctgggggttctatttggtgggttcccctctgcagattctgaccgcatctcccctctaaggagtatccctgaacctagtggggaggggcaggggcagactaccctcacccatgaagaggagtagggagagggagaagatgctttgagctccctctgggaagaggtggtaagcttggatctcagggtcacaagggccctgcgtgctccctcactttgcttctcttttgactggcctcccccagggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacacttaaaaaaaaaaa

SEQ ID NO: 4 - DNA, 2075 bp, Artificial Sequence
  OCT4
ggaaaaaaggaaagtgcacttggaagagatccaagtgggcaacttgaagaacaagtgccaaatagcacttctgtcatgctggatgtcagggctctttgtccactttgtatagccgctggcttatagaaggtgctcgataaatctcttgaatttaaaaatcaattaggatgcctctatagtgaaaaagatacagtaaagatgagggataatcaatttaaaaaatgagtaagtacacacaaagcactttatccattcttatgacacctgttacttttttgctgtgtttgtgtgtatgcatgccatgttatagtttgtgggaccctcaaagcaagctggggagagtatatactgaatttagcttctgagacatgatgctcttcctttttaattaacccagaacttagcagcttatctatttctctaatctcaaaacatccttaaactgggggtgatacttgagtgagagaattttgcaggtattaaatgaactatcttcttttttttttttctttgagacagagtcttgctctgtcacccaggctggagtgcagtggcgtgatctcagctcactgcaacctccgcctcccgggttcaagtgattctcctgcctcagcctcctgagtagctgggattacaggtgcgtgccaccgtgcccagctaatttttgtgtttttagtagagacggggtttcaccatgttggccatgctggtcttgaactcctgacctcgtgatctgcccacctcggcctcccaaagtgctggaattataggcgtgagccaccgcgcccagcaaagaacttctaaccttcataacctgacaggtgttctcgaggccagggtctctctttctgtcctttcacgatgctctgcatcccttggatgtgccagtttctgggggaagagtagtcctttgttacatgcatgagtcagtgaacagggaatgggtgaatgacatttgtgggtaggttatttctagaagttaggtgggcagcttggaaggcagatgcacttctacagactattccttggggccacacgtaggttcttgaatcccgaatggaaaggggagattgataactggtgtgtttatgttcttacaagtcttctgccttttaaaatccagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacacttaaaaaaaaaaa

SEQ ID NO: 5 - DNA, 1430 bp, Artificial Sequence
  OCT4
agagaggggttgagtagtcccttcgcaagccctcatttcaccaggcccccggcttggggcgccttccttccccatggcgggacacctggcttcggatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacacttaaaaaaaaaaa

SEQ ID NO: 6 - DNA, 991 bp, Artificial Sequence
  OCT4
gcagccttaaaacttcttcagaatagggtgacattttgtcctcagtggggcggttttgagtaatctgtgagcagataggaacttgctgggtcccaggacatgaaagccctgcagaaggagctagaacagtttgccaagctgctgaagcagaagaggatcaccttggggtacacccaggccgacgtggggctcaccctgggcgttctctttggaaaggtgttcagccagaccaccatctgtcgcttcgaggccttgcagctcagccttaagaacatgtgtaagctgcggcccctgctggagaagtgggtggaggaagccgacaacaatgagaaccttcaggagatatgcaaatcggagaccctggtgcaggcccggaagagaaagcgaactagcattgagaaccgtgtgaggtggagtctggagaccatgtttctgaagtgcccgaagccctccctacagcagatcactcacatcgccaatcagcttgggctagagaaggatgtggttcgagtatggttctgtaaccggcgccagaagggcaaaagatcaagtattgagtattcccaacgagaagagtatgaggctacagggacacctttcccagggggggctgtatcctttcctctgcccccaggtccccactttggcaccccaggctatggaagcccccacttcaccacactctactcagtcccttttcctgagggcgaggcctttccctctgttcccgtcactgctctgggctctcccatgcattcaaactgaggcaccagccctccctggggatgctgtgagccaaggcaagggaggtagacaagagaacctggagctttggggttaaattcttttactgaggagggattaaaagcacaacaggggtggggggtgggatggggaaagaagctcagtgatgctgttgatcaggagcctggcctgtctgtcactcatcattttgttcttaaataaagactgggacacacagtagatagct

SEQ ID NO: 7 - DNA, 1353 bp, Artificial Sequence
  OCT4
gaggtgaaaccgtccctaggtgagccgtctttccaccaggcccccggctcggggtgcccaccttccccatggctggacacctggcttcagacttcgccttctcacccccaccaggtgggggtgatgggtcagcagggctggagccgggctgggtggatcctcgaacctggctaagcttccaagggcctccaggtgggcctggaatcggaccaggctcagaggtattggggatctccccatgtccgcccgcatacgagttctgcggagggatggcatactgtggacctcaggttggactgggcctagtcccccaagttggcgtggagactttgcagcctgagggccaggcaggagcacgagtggaaagcaactcagagggaacctcctctgagccctgtgccgaccgccccaatgccgtgaagttggagaaggtggaaccaactcccgaggagtcccaggacatgaaagccctgcagaaggagctagaacagtttgccaagctgctgaagcagaagaggatcaccttggggtacacccaggccgacgtggggctcaccctgggcgttctctttggaaaggtgttcagccagaccaccatctgtcgcttcgaggccttgcagctcagccttaagaacatgtgtaagctgcggcccctgctggagaagtgggtggaggaagccgacaacaatgagaaccttcaggagatatgcaaatcggagaccctggtgcaggcccggaagagaaagcgaactagcattgagaaccgtgtgaggtggagtctggagaccatgtttctgaagtgcccgaagccctccctacagcagatcactcacatcgccaatcagcttgggctagagaaggatgtggttcgagtatggttctgtaaccggcgccagaagggcaaaagatcaagtattgagtattcccaacgagaagagtatgaggctacagggacacctttcccagggggggctgtatcctttcctctgcccccaggtccccactttggcaccccaggctatggaagcccccacttcaccacactctactcagtcccttttcctgagggcgaggcctttccctctgttcccgtcactgctctgggctctcccatgcattcaaactgaggcaccagccctccctggggatgctgtgagccaaggcaagggaggtagacaagagaacctggagctttggggttaaattcttttactgaggagggattaaaagcacaacaggggtggggggtgggatggggaaagaagctcagtgatgctgttgatcaggagcctggcctgtctgtcactcatcattttgttcttaaataaagactgggacacacagtagatagct

SEQ ID NO: 8 - protein, 265 aa, Artificial Sequence
  OCT4
MHFYRLFLGATRRFLNPEWKGEIDNWCVYVLTSLLPFKIQSQDIKALQKELEQFAKLLKQKRITLGYTQADVGLTLGVLFGKVFSQTTICRFEALQLSFKNMCKLRPLLQKWVEEADNNENLQEICKAETLVQARKRKRTSIENRVRGNLENLFLQCPKPTLQQISHIAQQLGLEKDVVRVWFCNRRQKGKRSSSDYAQREDFEAAGSPFSGGPVSFPLAPGPHFGTPGYGSPHFTALYSSVPFPEGEAFPPVSVTTLGSPMHSN

SEQ ID NO: 9 - protein, 360 aa, Artificial Sequence
  OCT4
MAGHLASDFAFSPPPGGGGDGPGGPEPGWVDPRTWLSFQGPPGGPGIGPGVGPGSEVWGIPPCPPPYEFCGGMAYCGPQVGVGLVPQGGLETSQPEGEAGVGVESNSDGASPEPCTVTPGAVKLEKEKLEQNPEESQDIKALQKELEQFAKLLKQKRITLGYTQADVGLTLGVLFGKVFSQTTICRFEALQLSFKNMCKLRPLLQKWVEEADNNENLQEICKAETLVQARKRKRTSIENRVRGNLENLFLQCPKPTLQQISHIAQQLGLEKDVVRVWFCNRRQKGKRSSSDYAQREDFEAAGSPFSGGPVSFPLAPGPHFGTPGYGSPHFTALYSSVPFPEGEAFPPVSVTTLGSPMHSN

SEQ ID NO: 10 - protein, 164 aa, Artificial Sequence
  OCT4
MCKLRPLLQKWVEEADNNENLQEICKAETLVQARKRKRTSIENRVRGNLENLFLQCPKPTLQQISHIAQQLGLEKDVVRVWFCNRRQKGKRSSSDYAQREDFEAAGSPFSGGPVSFPLAPGPHFGTPGYGSPHFTALYSSVPFPEGEAFPPVSVTTLGSPMHSN

SEQ ID NO: 11 - protein, 352 aa, Artificial Sequence
  OCT4
MAGHLASDFAFSPPPGGGDGSAGLEPGWVDPRTWLSFQGPPGGPGIGPGSEVLGISPCPPAYEFCGGMAYCGPQVGLGLVPQVGVETLQPEGQAGARVESNSEGTSSEPCADRPNAVKLEKVEPTPEESQDMKALQKELEQFAKLLKQKRITLGYTQADVGLTLGVLFGKVFSQTTICRFEALQLSLKNMCKLRPLLEKWVEEADNNENLQEICKSETLVQARKRKRTSIENRVRWSLETMFLKCPKPSLQQITHIANQLGLEKDVVRVWFCNRRQKGKRSSIEYSQREEYEATGTPFPGGAVSFPLPPGPHFGTPGYGSPHFTTLYSVPFPEGEAFPSVPVTALGSPMHSN

SEQ ID NO: 12 - DNA, 3014 bp, Artificial Sequence
  Klf4
gcagaggcggtggcgggcggcggcggcaccgggagccgccgagtgaccctcccccgcccctctggccccccaccctcccacccgcccgtggcccgcgcccatggccgcgcgcgctccacacaactcaccggagtccgcgccttgcgccgccgaccagttcgcagctccgcgccacggcagccagtctcacctggcggcaccgcccgcccaccgccccggccacagcccctgcgcccacggcagcactcgaggcgaccgcgacagtggtgggggacgctgctgagtggaagagagcgcagcccggccaccggacctacttactcgccttgctgattgtctatttttgcgtttacaacttttctaagaacttttgtatacaaaggaactttttaaaaaagacgcttccaagttatatttaatccaaagaagaaggatctcggccaatttggggttttgggttttggcttcgtttcttctcttcgttgactttggggttcaggtgccccagctgcttcgggctgccgaggaccttctgggcccccacattaatgaggcagccacctggcgagtctgacatggctgtcagcgacgcgctgctcccatctttctccacgttcgcgtctggcccggcgggaagggagaagacactgcgtcaagcaggtgccccgaataaccgctggcgggaggagctctcccacatgaagcgacttcccccagtgcttcccggccgcccctatgacctggcggcggcgaccgtggccacagacctggagagcggcggagccggtgcggcttgcggcggtagcaacctggcgcccctacctcggagagagaccgaggagttcaacgatctcctggacctggactttattctctccaattcgctgacccatcctccggagtcagtggccgccaccgtgtcctcgtcagcgtcagcctcctcttcgtcgtcgccgtcgagcagcggccctgccagcgcgccctccacctgcagcttcacctatccgatccgggccgggaacgacccgggcgtggcgccgggcggcacgggcggaggcctcctctatggcagggagtccgctccccctccgacggctcccttcaacctggcggacatcaacgacgtgagcccctcgggcggcttcgtggccgagctcctgcggccagaattggacccggtgtacattccgccgcagcagccgcagccgccaggtggcgggctgatgggcaagttcgtgctgaaggcgtcgctgagcgcccctggcagcgagtacggcagcccgtcggtcatcagcgtcagcaaaggcagccctgacggcagccacccggtggtggtggcgccctacaacggcgggccgccgcgcacgtgccccaagatcaagcaggaggcggtctcttcgtgcacccacttgggcgctggaccccctctcagcaatggccaccggccggctgcacacgacttccccctggggcggcagctccccagcaggactaccccgaccctgggtcttgaggaagtgctgagcagcagggactgtcaccctgccctgccgcttcctcccggcttccatccccacccggggcccaattacccatccttcctgcccgatcagatgcagccgcaagtcccgccgctccattaccaaggtcagtcccggggatttgtagctcgggctggggagccctgtgtgtgctggccccacttcgggacacacgggatgatgctcaccccaccttcttcacccctagagctcatgccacccggttcctgcatgccagaggagcccaagccaaagaggggaagacgatcgtggccccggaaaaggaccgccacccacacttgtgattacgcgggctgcggcaaaacctacacaaagagttcccatctcaaggcacacctgcgaacccacacaggtgagaaaccttaccactgtgactgggacggctgtggatggaaattcgcccgctcagatgaactgaccaggcactaccgtaaacacacggggcaccgcccgttccagtgccaaaaatgcgaccgagcattttccaggtcggaccacctcgccttacacatgaagaggcatttttaaatcccagacagtggatatgacccacactgccagaagagaattcagtattttttacttttcacactgtcttcccgatgagggaaggagcccagccagaaagcactacaatcatggtcaagttcccaactgagtcatcttgtgagtggataatcaggaaaaatgaggaatccaaaagacaaaaatcaaagaacagatggggtctgtgactggatcttctatcattccaattctaaatccgacttgaatattcctggacttacaaaatgccaagggggtgactggaagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgatggtgcttggtgagtcttggttctaaaggtaccaaacaaggaagccaaagttttcaaactgctgcatactttgacaaggaaaatctatatttgtcttccgatcaacatttatgacctaagtcaggtaatatacctggtttacttctttagcatttttatgcagacagtctgttatgcactgtggtttcagatgtgcaataatttgtacaatggtttattcccaagtatgccttaagcagaacaaatgtgtttttctatatagttccttgccttaataaatatgtaatataaatttaagcaaacgtctattttgtatatttgtaaactacaaagtaaaatgaacattttgtggagtttgtattttgcatactcaaggtgagaattaagttttaaataaacctataatattttataaaaaaaaaaaaaaaaaaaaaaaaaaaaaa

SEQ ID NO: 13 - DNA, 3057 bp, Artificial Sequence
  Klf4
agttccccggccaagagagcgagcgcggctccgggcgcgcggggagcagaggcggtggcgggcggcggcggcacccggagccgccgagtgcccctccccgcccctccagccccccacccagcaacccgcccgtgacccgcgcccatggccgcgcgcacccggcacagtccccaggactccgcaccccgcgccaccgcccagctcgcagttccgcgccaccgcggccattctcacctggcggcgccgcccgcccaccgcccggaccacagcccccgcgccgccgacagccacagtggccgcgacaacggtgggggacactgctgagtccaagagcgtgcagcctggccatcggacctacttatctgccttgctgattgtctatttttataagagtttacaacttttctaagaatttttgtatacaaaggaacttttttaaagacatcgccggtttatattgaatccaaagaagaaggatctcgggcaatctgggggttttggtttgaggttttgtttctaaagtttttaatcttcgttgactttggggctcaggtacccctctctcttcttcggactccggaggaccttctgggcccccacattaatgaggcagccacctggcgagtctgacatggctgtcagcgacgctctgctcccgtccttctccacgttcgcgtccggcccggcgggaagggagaagacactgcgtccagcaggtgccccgactaaccgttggcgtgaggaactctctcacatgaagcgacttcccccacttcccggccgcccctacgacctggcggcgacggtggccacagacctggagagtggcggagctggtgcagcttgcagcagtaacaacccggccctcctagcccggagggagaccgaggagttcaacgacctcctggacctagactttatcctttccaactcgctaacccaccaggaatcggtggccgccaccgtgaccacctcggcgtcagcttcatcctcgtcttccccggcgagcagcggccctgccagcgcgccctccacctgcagcttcagctatccgatccgggccgggggtgacccgggcgtggctgccagcaacacaggtggagggctcctctacagccgagaatctgcgccacctcccacggcccccttcaacctggcggacatcaatgacgtgagcccctcgggcggcttcgtggctgagctcctgcggccggagttggacccagtatacattccgccacagcagcctcagccgccaggtggcgggctgatgggcaagtttgtgctgaaggcgtctctgaccacccctggcagcgagtacagcagcccttcggtcatcagtgttagcaaaggaagcccagacggcagccaccccgtggtagtggcgccctacagcggtggcccgccgcgcatgtgccccaagattaagcaagaggcggtcccgtcctgcacggtcagccggtccctagaggcccatttgagcgctggaccccagctcagcaacggccaccggcccaacacacacgacttccccctggggcggcagctccccaccaggactacccctacactgagtcccgaggaactgctgaacagcagggactgtcaccctggcctgcctcttcccccaggattccatccccatccggggcccaactaccctcctttcctgccagaccagatgcagtcacaagtcccctctctccattatcaagagctcatgccaccgggttcctgcctgccagaggagcccaagccaaagaggggaagaaggtcgtggccccggaaaagaacagccacccacacttgtgactatgcaggctgtggcaaaacctataccaagagttctcatctcaaggcacacctgcgaactcacacaggcgagaaaccttaccactgtgactgggacggctgtgggtggaaattcgcccgctccgatgaactgaccaggcactaccgcaaacacacagggcaccggccctttcagtgccagaagtgtgacagggccttttccaggtcggaccaccttgccttacacatgaagaggcacttttaaatcccacgtagtggatgtgacccacactgccaggagagagagttcagtatttttttttctaacctttcacactgtcttcccacgaggggaggagcccagctggcaagcgctacaatcatggtcaagttcccagcaagtcagcttgtgaatggataatcaggagaaaggaagagttcaagagacaaaacagaaatactaaaaacaaacaaacaaaaaaacaaacaaaaaaaacaagaaaaaaaaatcacagaacagatggggtctgatactggatggatcttctatcattccaataccaaatccaacttgaacatgcccggacttacaaaatgccaaggggtgactggaagtttgtggatatcagggtatacactaaatcagtgagcttggggggagggaagaccaggattcccttgaattgtgtttcgatgatgcaatacacacgtaaagatcaccttgtatgctctttgccttcttaaaaaaaaaaaaagccattattgtgtcggaggaagaggaagcgattcaggtacagaacatgttctaacagcctaaatgatggtgcttggtgagtcgtggttctaaaggtaccaaacgggggagccaaagttctccaactgctgcatacttttgacaaggaaaatctagttttgtcttccgatctacattgatgacctaagccaggtaaataagcctggtttatttctgtaacatttttatgcagacagtctgttatgcactgtggtttcagatgtgcaataatttgtacaatggtttattcccaagtatgcctttaagcagaacaaatgtgtttttctatatagttccttgccttaataaatatgtaatataaatttaagcaaacttctattttgtatatttgtaaactacaaagtaaaaaaaaatgaacattttgtggagtttgtattttgcatactcaaggtgagaaataagttttaaataaacctataatattttatctgaacgacaaaaaaaaaaaaaaa

SEQ ID NO: 14 - protein, 479 aa, Artificial Sequence
  Klf4
MRQPPGESDMAVSDALLPSFSTFASGPAGREKTLRQAGAPNNRWREELSHMKRLPPVLPGRPYDLAAATVATDLESGGAGAACGGSNLAPLPRRETEEFNDLLDLDFILSNSLTHPPESVAATVSSSASASSSSSPSSSGPASAPSTCSFTYPIRAGNDPGVAPGGTGGGLLYGRESAPPPTAPFNLADINDVSPSGGFVAELLRPELDPVYIPPQQPQPPGGGLMGKFVLKASLSAPGSEYGSPSVISVSKGSPDGSHPVVVAPYNGGPPRTCPKIKQEAVSSCTHLGAGPPLSNGHRPAAHDFPLGRQLPSRTTPTLGLEEVLSSRDCHPALPLPPGFHPHPGPNYPSFLPDQMQPQVPPLHYQELMPPGSCMPEEPKPKRGRRSWPRKRTATHTCDYAGCGKTYTKSSHLKAHLRTHTGEKPYHCDWDGCGWKFARSDELTRHYRKHTGHRPFQCQKCDRAFSRSDHLALHMKRHF

SEQ ID NO: 15 - protein, 513 aa, Artificial Sequence
  Klf4
MRQPPGESDMAVSDALLPSFSTFASGPAGREKTLRQAGAPNNRWREELSHMKRLPPVLPGRPYDLAAATVATDLESGGAGAACGGSNLAPLPRRETEEFNDLLDLDFILSNSLTHPPESVAATVSSSASASSSSSPSSSGPASAPSTCSFTYPIRAGNDPGVAPGGTGGGLLYGRESAPPPTAPFNLADINDVSPSGGFVAELLRPELDPVYIPPQQPQPPGGGLMGKFVLKASLSAPGSEYGSPSVISVSKGSPDGSHPVVVAPYNGGPPRTCPKIKQEAVSSCTHLGAGPPLSNGHRPAAHDFPLGRQLPSRTTPTLGLEEVLSSRDCHPALPLPPGFHPHPGPNYPSFLPDQMQPQVPPLHYQGQSRGFVARAGEPCVCWPHFGTHGMMLTPPSSPLELMPPGSCMPEEPKPKRGRRSWPRKRTATHTCDYAGCGKTYTKSSHLKAHLRTHTGEKPYHCDWDGCGWKFARSDELTRHYRKHTGHRPFQCQKCDRAFSRSDHLALHMKRHF

SEQ ID NO: 16 - protein, 513 aa, Artificial Sequence; identical to SEQ ID NO: 15
  Klf4

SEQ ID NO: 17 - DNA, 2520 bp, Artificial Sequence
  Sox2
ggatggttgtctattaacttgttcaaaaaagtatcaggagttgtcaaggcagagaagagagtgtttgcaaaagggggaaagtagtttgctgcctctttaagactaggactgagagaaagaagaggagagagaaagaaagggagagaagtttgagccccaggcttaagcctttccaaaaaataataataacaatcatcggcggcggcaggatcggccagaggaggagggaagcgctttttttgatcctgattccagtttgcctctctctttttttcccccaaattattcttcgcctgattttcctcgcggagccctgcgctcccgacacccccgcccgcctcccctcctcctctccccccgcccgcgggccccccaaagtcccggccgggccgagggtcggcggccgccggcgggccgggcccgcgcacagcgcccgcatgtacaacatgatggagacggagctgaagccgccgggcccgcagcaaacttcggggggcggcggcggcaactccaccgcggcggcggccggcggcaaccagaaaaacagcccggaccgcgtcaagcggcccatgaatgccttcatggtgtggtcccgcgggcagcggcgcaagatggcccaggagaaccccaagatgcacaactcggagatcagcaagcgcctgggcgccgagtggaaacttttgtcggagacggagaagcggccgttcatcgacgaggctaagcggctgcgagcgctgcacatgaaggagcacccggattataaataccggccccggcggaaaaccaagacgctcatgaagaaggataagtacacgctgcccggcgggctgctggcccccggcggcaatagcatggcgagcggggtcggggtgggcgccggcctgggcgcgggcgtgaaccagcgcatggacagttacgcgcacatgaacggctggagcaacggcagctacagcatgatgcaggaccagctgggctacccgcagcacccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtgagggccggacagcgaactggaggggggagaaattttcaaagaaaaacgagggaaatgggaggggtgcaaaagaggagagtaagaaacagcatggagaaaacccggtacgctcaaaaagaaaaaggaaaaaaaaaaatcccatcacccacagcaaatgacagctgcaaaagagaacaccaatcccatccacactcacgcaaaaaccgcgatgccgacaagaaaacttttatgagagagatcctggacttctttttgggggactatttttgtacagagaaaacctggggagggtggggagggcgggggaatggaccttgtatagatctggaggaaagaaagctacgaaaaactttttaaaagttctagtggtacggtaggagctttgcaggaagtttgcaaaagtctttaccaataatatttagagctagtctccaagcgacgaaaaaaatgttttaatatttgcaagcaacttttgtacagtatttatcgagataaacatggcaatcaaaatgtccattgtttataagctgagaatttgccaatatttttcaaggagaggcttcttgctgaattttgattctgcagctgaaatttaggacagttgcaaacgtgaaaagaagaaaattattcaaatttggacattttaattgtttaaaaattgtacaaaaggaaaaaattagaataagtactggcgaaccatctctgtggtcttgtttaaaaagggcaaaagttttagactgtactaaattttataacttactgttaaaagcaaaaatggccatgcaggttgacaccgttggtaatttataatagcttttgttcgatcccaactttccattttgttcagataaaaaaaaccatgaaattactgtgtttgaaatattttcttatggtttgtaatatttctgtaaatttattgtgatattttaaggttttcccccctttattttccgtagttgtattttaaaagattcggctctgtattatttgaatcagtctgccgagaatccatgtatatatttgaactaatatcatccttataacaggtacattttcaacttaagtttttactccattatgcacagtttgagataaataaatttttgaaatatggacactgaaaaaaaaaa

SEQ ID NO: 18 - DNA, 2480 bp, Artificial Sequence
  Sox2
ggatggttgtctattaacttgttcaaaaaagtatcaggagttgtcaaggcagagaagagagtgtttgcaaaaagggaaaagtactttgctgcctctttaagactagggctgggagaaagaagaggagagagaaagaaaggagagaagtttggagcccgaggcttaagcctttccaaaaactaatcacaacaatcgcggcggcccgaggaggagagcgcctgttttttcatcccaattgcacttcgcccgtctcgagctccgcttccccccaactattctccgccagatctccgcgcagggccgtgcacgccgaggcccccgcccgcggcccctgcatcccggcccccgagcgcggcccccacagtcccggccgggccgagggttggcggccgccggcgggccgcgcccgcccagcgcccgcatgtataacatgatggagacggagctgaagccgccgggcccgcagcaagcttcggggggcggcggcggaggaggcaacgccacggcggcggcgaccggcggcaaccagaagaacagcccggaccgcgtcaagaggcccatgaacgccttcatggtatggtcccgggggcagcggcgtaagatggcccaggagaaccccaagatgcacaactcggagatcagcaagcgcctgggcgcggagtggaaacttttgtccgagaccgagaagcggccgttcatcgacgaggccaagcggctgcgcgctctgcacatgaaggagcacccggattataaataccggccgcggcggaaaaccaagacgctcatgaagaaggataagtacacgcttcccggaggcttgctggcccccggcgggaacagcatggcgagcggggttggggtgggcgccggcctgggtgcgggcgtgaaccagcgcatggacagctacgcgcacatgaacggctggagcaacggcagctacagcatgatgcaggagcagctgggctacccgcagcacccgggcctcaacgctcacggcgcggcacagatgcaaccgatgcaccgctacgacgtcagcgccctgcagtacaactccatgaccagctcgcagacctacatgaacggctcgcccacctacagcatgtcctactcgcagcagggcacccccggtatggcgctgggctccatgggctctgtggtcaagtccgaggccagctccagcccccccgtggttacctcttcctcccactccagggcgccctgccaggccggggacctccgggacatgatcagcatgtacctccccggcgccgaggtgccggagcccgctgcgcccagtagactgcacatggcccagcactaccagagcggcccggtgcccggcacggccattaacggcacactgcccctgtcgcacatgtgagggctggactgcgaactggagaaggggagagattttcaaagagatacaagggaattgggaggggtgcaaaaagaggagagtaggaaaaatctgataatgctcaaaaggaaaaaaaatctccgcagcgaaacgacagctgcggaaaaaaaccaccaatcccatccaaattaacgcaaaaaccgtgatgccgactagaaaacttttatgagagatcttgggacttctttttgggggactatttttgtacagagaaaacctgagggcggcggggagggcgggggaatcggaccatgtatagatctggaggaaaaaaactacgcaaaacttttttttaaagttctagtggtacgttaggcgcttcgcagggagttcgcaaaagtctttaccagtaatatttagagctagactccgggcgatgaaaaaaaagttttaatatttgcaagcaacttttgtacagtatttatcgagataaacatggcaatcaaatgtccattgtttataagctgagaatttgccaatatttttcgaggaaagggttcttgctgggttttgattctgcagcttaaatttaggaccgttacaaacaaggaaggagtttattcggatttgaacattttagttttaaaattgtacaaaaggaaaacatgagagcaagtactggcaagaccgttttcgtggtcttgtttaaggcaaacgttctagattgtactaaatttttaacttactgttaaaggcaaaaaaaaaatgtccatgcaggttgatatcgttggtaatttataatagcttttgttcaatcctaccctttcattttgttcacataaaaaatatggaattactgtgtttgaaatattttcttatggtttgtaatatttctgtaaattgtgatattttaaggtttttccccccttttattttccgtagttgtattttaaaagattcggctctgttattggaatcaggctgccgagaatccatgtatatatttgaactaataccatccttataacagctacattttcaacttaagtttttactccattatgcacagtttgagataaataaatttttgaaatatggacactgaaaaaaaaaaaaaaaa

SEQ ID NO: 19 - protein, 317 aa, Artificial Sequence
  Sox2
MYNMMETELKPPGPQQTSGGGGGNSTAAAAGGNQKNSPDRVKRPMNAFMVWSRGQRRKMAQENPKMHNSEISKRLGAEWKLLSETEKRPFIDEAKRLRALHMKEHPDYKYRPRRKTKTLMKKDKYTLPGGLLAPGGNSMASGVGVGAGLGAGVNQRMDSYAHMNGWSNGSYSMMQDQLGYPQHPGLNAHGAAQMQPMHRYDVSALQYNSMTSSQTYMNGSPTYSMSYSQQGTPGMALGSMGSVVKSEASSSPPVVTSSSHSRAPCQAGDLRDMISMYLPGAEVPEPAAPSRLHMSQHYQSGPVPGTAINGTLPLSHM

SEQ ID NO: 20 - protein, 319 aa, Artificial Sequence
  Sox2
MYNMMETELKPPGPQQASGGGGGGGNATAAATGGNQKNSPDRVKRPMNAFMVWSRGQRRKMAQENPKMHNSEISKRLGAEWKLLSETEKRPFIDEAKRLRALHMKEHPDYKYRPRRKTKTLMKKDKYTLPGGLLAPGGNSMASGVGVGAGLGAGVNQRMDSYAHMNGWSNGSYSMMQEQLGYPQHPGLNAHGAAQMQPMHRYDVSALQYNSMTSSQTYMNGSPTYSMSYSQQGTPGMALGSMGSVVKSEASSSPPVVTSSSHSRAPCQAGDLRDMISMYLPGAEVPEPAAPSRLHMAQHYQSGPVPGTAINGTLPLSHM

SEQ ID NO: 21 - DNA, 2379 bp, Artificial Sequence
  cMyc
gacccccgagctgtgctgctcgcggccgccaccgccgggccccggccgtccctggctcccctcctgcctcgagaagggcagggcttctcagaggcttggcgggaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaatcttaaaaaaaaaaaaaaa

SEQ ID NO: 22 - DNA, 2399 bp, Artificial Sequence
  cMyc
cccgcccacccgccctttatattccgggggtctgcgcggccgaggacccctgggctgcgctgctctcagctgccgggtccgactcgcctcactcagctcccctcctgcctcctgaagggcagggcttcgccgacgcttggcgggaaaaagaagggaggggagggatcctgagtcgcagtataaaagaagcttttcgggcgtttttttctgactcgctgtagtaattccagcgagagacagagggagtgagcggacggttggaagagccgtgtgtgcagagccgcgctccggggcgacctaagaaggcagctctggagtgagaggggctttgcctccgagcctgccgcccactctccccaaccctgcgactgacccaacatcagcggccgcaaccctcgccgccgctgggaaactttgcccattgcagcgggcagacacttctcactggaacttacaatctgcgagccaggacaggactccccaggctccggggagggaatttttgtctatttggggacagtgttctctgcctctgcccgcgatcagctctcctgaaaagagctcctcgagctgtttgaaggctggatttcctttgggcgttggaaaccccgcagacagccacgacgatgcccctcaacgtgaacttcaccaacaggaactatgacctcgactacgactccgtacagccctatttcatctgcgacgaggaagagaatttctatcaccagcaacagcagagcgagctgcagccgcccgcgcccagtgaggatatctggaagaaattcgagctgcttcccaccccgcccctgtccccgagccgccgctccgggctctgctctccatcctatgttgcggtcgctacgtccttctccccaagggaagacgatgacggcggcggtggcaacttctccaccgccgatcagctggagatgatgaccgagttacttggaggagacatggtgaaccagagcttcatctgcgatcctgacgacgagaccttcatcaagaacatcatcatccaggactgtatgtggagcggtttctcagccgctgccaagctggtctcggagaagctggcctcctaccaggctgcgcgcaaagacagcaccagcctgagccccgcccgcgggcacagcgtctgctccacctccagcctgtacctgcaggacctcaccgccgccgcgtccgagtgcattgacccctcagtggtctttccctacccgctcaacgacagcagctcgcccaaatcctgtacctcgtccgattccacggccttctctccttcctcggactcgctgctgtcctccgagtcctccccacgggccagccctgagcccctagtgctgcatgaggagacaccgcccaccaccagcagcgactctgaagaagagcaagaagatgaggaagaaattgatgtggtgtctgtggagaagaggcaaacccctgccaagaggtcggagtcgggctcatctccatcccgaggccacagcaaacctccgcacagcccactggtcctcaagaggtgccacgtctccactcaccagcacaactacgccgcacccccctccacaaggaaggactatccagctgccaagagggccaagttggacagtggcagggtcctgaagcagatcagcaacaaccgcaagtgctccagccccaggtcctcagacacggaggaaaacgacaagaggcggacacacaacgtcttggaacgtcagaggaggaacgagctgaagcgcagcttttttgccctgcgtgaccagatccctgaattggaaaacaacgaaaaggcccccaaggtagtgatcctcaaaaaagccaccgcctacatcctgtccattcaagcagacgagcacaagctcacctctgaaaaggacttattgaggaaacgacgagaacagttgaaacacaaactcgaacagcttcgaaactctggtgcataaactgacctaactcgaggaggagctggaatctctcgtgagagtaaggagaacggttccttctgacagaactgatgcgctggaattaaaatgcatgctcaaagcctaacctcacaaccttggctggggctttgggactgtaagcttcagccataattttaactgcctcaaacttaaatagtataaaagaacttttttttatgcttcccatcttttttctttttccttttaacagatttgtatttaattgtttttttaaaaaaatcttaaaatctatccaattttcccatgtaaatagggccttgaaatgtaaataactttaataaaacgtttataacagttacaaaagattttaagacatgtaccataattttttttatttaaagacattttcatttttaaagttgatttttttctattgtttttagaaaaaaataaaataattggaaaaaatac

SEQ ID NO: 23 - DNA, 2396 bp, Artificial Sequence
  cMyc
cccgcccacccgccctttatattccgggggtctgcgcggccgaggacccctgggctgcgctgctctcagctgccgggtccgactcgcctcactcagctcccctcctgcctcctgaagggcagggcttcgccgacgcttggcgggaaaaagaagggaggggagggatcctgagtcgcagtataaaagaagcttttcgggcgtttttttctgactcgctgtagtaattccagcgagagacagagggagtgagcggacggttggaagagccgtgtgtgcagagccgcgctccggggcgacctaagaaggcagctctggagtgagaggggctttgcctccgagcctgccgcccactctccccaaccctgcgactgacccaacatcagcggccgcaaccctcgccgccgctgggaaactttgcccattgcagcgggcagacacttctcactggaacttacaatctgcgagccaggacaggactccccaggctccggggagggaatttttgtctatttggggacagtgttctctgcctctgcccgcgatcagctctcctgaaaagagctcctcgagctgtttgaaggctggatttcctttgggcgttggaaaccccgacagccacgacgatgcccctcaacgtgaacttcaccaacaggaactatgacctcgactacgactccgtacagccctatttcatctgcgacgaggaagagaatttctatcaccagcaacagcagagcgagctgcagccgcccgcgcccagtgaggatatctggaagaaattcgagctgcttcccaccccgcccctgtccccgagccgccgctccgggctctgctctccatcctatgttgcggtcgctacgtccttctccccaagggaagacgatgacggcggcggtggcaacttctccaccgccgatcagctggagatgatgaccgagttacttggaggagacatggtgaaccagagcttcatctgcgatcctgacgacgagaccttcatcaagaacatcatcatccaggactgtatgtggagcggtttctcagccgctgccaagctggtctcggagaagctggcctcctaccaggctgcgcgcaaagacagcaccagcctgagccccgcccgcgggcacagcgtctgctccacctccagcctgtacctgcaggacctcaccgccgccgcgtccgagtgcattgacccctcagtggtctttccctacccgctcaacgacagcagctcgcccaaatcctgtacctcgtccgattccacggccttctctccttcctcggactcgctgctgtcctccgagtcctccccacgggccagccctgagcccctagtgctgcatgaggagacaccgcccaccaccagcagcgactctgaagaagagcaagaagatgaggaagaaattgatgtggtgtctgtggagaagaggcaaacccctgccaagaggtcggagtcgggctcatctccatcccgaggccacagcaaacctccgcacagcccactggtcctcaagaggtgccacgtctccactcaccagcacaactacgccgcacccccctccacaaggaaggactatccagctgccaagagggccaagttggacagtggcagggtcctgaagcagatcagcaacaaccgcaagtgctccagccccaggtcctcagacacggaggaaaacgacaagaggcggacacacaacgtcttggaacgtcagaggaggaacgagctgaagcgcagcttttttgccctgcgtgaccagatccctgaattggaaaacaacgaaaaggcccccaaggtagtgatcctcaaaaaagccaccgcctacatcctgtccattcaagcagacgagcacaagctcacctctgaaaaggacttattgaggaaacgacgagaacagttgaaacacaaactcgaacagcttcgaaactctggtgcataaactgacctaactcgaggaggagctggaatctctcgtgagagtaaggagaacggttccttctgacagaactgatgcgctggaattaaaatgcatgctcaaagcctaacctcacaaccttggctggggctttgggactgtaagcttcagccataattttaactgcctcaaacttaaatagtataaaagaacttttttttatgcttcccatcttttttctttttccttttaacagatttgtatttaattgtttttttaaaaaaatcttaaaatctatccaattttcccatgtaaatagggccttgaaatgtaaataactttaataaaacgtttataacagttacaaaagattttaagacatgtaccataattttttttatttaaagacattttcatttttaaagttgatttttttctattgtttttagaaaaaaataaaataattggaaaaaatac

SEQ ID NO: 24 - DNA, 2396 bp, Artificial Sequence; identical to SEQ ID NO: 23
  cMyc

SEQ ID NO: 25 - DNA, 2399 bp, Artificial Sequence; identical to SEQ ID NO: 22
  cMyc

SEQ ID NO: 26 - protein, 454 aa, Artificial Sequence
  cMyc
MDFFRVVENQQPPATMPLNVSFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSEEEQEDEEEIDVVSVEKRQAPGKRSESGSPSAGGHSKPPHSPLVLKRCHVSTHQHNYAAPPSTRKDYPAAKRVKLDSVRVLRQISNNRKCTSPRSSDTEENVKRRTHNVLERQRRNELKRSFFALRDQIPELENNEKAPKVVILKKATAYILSVQAEEQKLISEEDLLRKRREQLKHKLEQLRNSCA

SEQ ID NO: 27 - protein, 439 aa, Artificial Sequence
  cMyc
MPLNVNFTNRNYDLDYDSVQPYFICDEEENFYHQQQQSELQPPAPSEDIWKKFELLPTPPLSPSRRSGLCSPSYVAVATSFSPREDDDGGGGNFSTADQLEMMTELLGGDMVNQSFICDPDDETFIKNIIIQDCMWSGFSAAAKLVSEKLASYQAARKDSTSLSPARGHSVCSTSSLYLQDLTAAASECIDPSVVFPYPLNDSSSPKSCTSSDSTAFSPSSDSLLSSESSPRASPEPLVLHEETPPTTSSDSEEEQEDEEEIDVVSVEKRQTPAKRSESGSSPSRGHSKPPHSPLVLKRCHVSTHQHNYAAPPSTRKDYPAAKRAKLDSGRVLKQISNNRKCSSPRSSDTEENDKRRTHNVLERQRRNELKRSFFALRDQIPELENNEKAPKVVILKKATAYILSIQADEHKLTSEKDLLRKRREQLKHKLEQLRNSGA

SEQ ID NO: 28 - protein, 453 aa, Artificial Sequence
  cMyc
MDFLWALETPTATTMPLNVNFTNRNYDLDYDSVQPYFICDEEENFYHQQQQSELQPPAPSEDIWKKFELLPTPPLSPSRRSGLCSPSYVAVATSFSPREDDDGGGGNFSTADQLEMMTELLGGDMVNQSFICDPDDETFIKNIIIQDCMWSGFSAAAKLVSEKLASYQAARKDSTSLSPARGHSVCSTSSLYLQDLTAAASECIDPSVVFPYPLNDSSSPKSCTSSDSTAFSPSSDSLLSSESSPRASPEPLVLHEETPPTTSSDSEEEQEDEEEIDVVSVEKRQTPAKRSESGSSPSRGHSKPPHSPLVLKRCHVSTHQHNYAAPPSTRKDYPAAKRAKLDSGRVLKQISNNRKCSSPRSSDTEENDKRRTHNVLERQRRNELKRSFFALRDQIPELENNEKAPKVVILKKATAYILSIQADEHKLTSEKDLLRKRREQLKHKLEQLRNSGA

SEQ ID NO: 29 - protein, 439 aa, Artificial Sequence; identical to SEQ ID NO: 27
  cMyc

SEQ ID NO: 30 - DNA, 3315 bp, Artificial Sequence
  CNTN1
cttctgctgtcaagtagccagggtgggctccgccgaggcgaggaggggcgccggtggggagatgcgctcccaggtgtttgcagcggaagtgggaaacctgtagggtatggtccagctgtgccgcaccgaggcgagcaggagcagggaacaggtgtttaaaattatccaactgccatagagctaaattcttttttggaaaattgaaccgaacttctactgaatacaagatgaaaatgtggttgctggtcagtcatcttgtgataatatctattactacctgtttagcagagtttacatggtatagaagatatggtcatggagtttctgaggaagacaaaggatttggaccaatttttgaagagcagccaatcaataccatttatccagaggaatcactggaaggaaaagtctcactcaactgtagggcacgagccagccctttcccggtttacaaatggagaatgaataatggggacgttgatctcacaagtgatcgatacagtatggtaggaggaaaccttgttatcaacaaccctgacaaacagaaagatgctggaatatactactgtttagcatctaataactacgggatggtcagaagcactgaagcaaccctgagctttggatatcttgatcctttcccacctgaggaacgtcctgaggtcagagtaaaagaagggaaaggaatggtgcttctctgtgaccccccataccattttccagatgatcttagctatcgctggcttctaaatgaatttcctgtatttatcacaatggataaacggcgatttgtgtctcagacaaatggcaatctctacattgcaaatgttgaggcttccgacaaaggcaattattcctgctttgtttccagtccttctattacaaagagcgtgttcagcaaattcatcccactcattccaatacctgaacgaacaacaaaaccatatcctgctgatattgtagttcagttcaaggatgtatatgcattgatgggccaaaatgtgaccttagaatgttttgcacttggaaatcctgttccggatatccgatggcggaaggttctagaaccaatgccaagcactgctgagattagcacctctggggctgttcttaagatcttcaatattcagctagaagatgaaggcatctatgaatgtgaggctgagaacattagaggaaaggataaacatcaagcaagaatttatgttcaagcattccctgagtgggtagaacacatcaatgacacagaggtggacataggcagtgatctctactggccttgtgtggccacaggaaagcccatccctacaatccgatggttgaaaaatggatatgcgtatcataaaggggaattaagactgtatgatgtgacttttgaaaatgccggaatgtatcagtgcatagctgaaaacacatatggagccatttatgcaaatgctgagttgaagatcttggcgttggctccaacttttgaaatgaatcctatgaagaaaaagatcctggctgctaaaggtggaagggtgataattgaatgcaaacctaaagctgcaccgaaaccaaagttttcatggagtaaagggacagagtggcttgtcaatagcagcagaatactcatttgggaagatggtagcttggaaatcaacaacattacaaggaatgatggaggtatctatacatgctttgcagaaaataacagagggaaagctaatagcactggaacccttgttatcacagatcctacgcgaattatattggccccaattaatgccgatatcacagttggagaaaacgccaccatgcagtgtgctgcgtcctttgatcctgccttggatctcacatttgtttggtccttcaatggctatgtgatcgattttaacaaagagaatattcactaccagaggaattttatgctggattccaatggggaattactaatccgaaatgcgcagctgaaacatgctggaagatacacatgcactgcccagacaattgtggacaattcttcagcttcagctgaccttgtagtgagaggtaaaaacagaaaaggtggagagaaaaacatggtggattcctttctccccgtctgtgcaagcctgcctccaacctggtgatcgttgacactcaccatttctgtgaaagacttttttttttttaacatattatactagatttgactaactcaatcttgtagcttctgcagttctccccacccccaacctagttcttagagtatgtttccccttttgaaacatgtaaacatactttgggcataaatattttttaaaatataactataatgcttcactaataccttaaaaatgcctagtgaactaactcagtacattatataatggccaagtgaaagttttgtgttttcatgtcctgtttttctttgaaattatatagcccagaaattagctcattatctgaaaaacgtatgaagaactgatgaattgtataatacaggagtattgccattgaatgtactgtttgatttattcaagcaggtaatgaacaatgttgtcaaactctctaatgagacatcataattaggacataagctaaaaggggcattactccggcagtctttttttcttaatcctagtaccatacatattctttggcatgaaagaatgaaaagcattagtaaacaactgaagtcctaccatggctctgtagggtttttggaacaattcctggaattggaaagtgaaaatggatagcatgtgggggaaaccctcatctgagtagcaagattttagtaaagatgactaagccattaacagcatgcattcatatttaattttattgactcctgccatcagcttttgtagatcgtttgggtggaaggttgtgatttttactgggaggacttgagtagaagtggatgattaaaattgaggagtatataattctttctgggactgcttaaatgttattgtttgaaaataccttcactttccccctttggtcaaagagatgtgcttaaaattcttattccttcacaataaataattttgattttcttagacaggtttgtgtttaggtatgagtttctcttttacttcatctagcaattctctctgtggtcagaagaactctgaagaaagctttgagggaaatgaatataactcttaaattattatatgtgtgtgtatatatatagtttaactttaaaaataatttattagtcatcataaagaaataaatgtctctggctcaagatgttacttatttccttcttttatattttctagtctcaattactgttccaaaaggagctatcttagaacttagactagagatccagattaa

SEQ ID NO: 31 - DNA, 3528 bp, Artificial Sequence
  CNTN1
agatagtttcttgcattaagtgactgcagtgaaatgcttaatattttcaggcatagaagcagcattgactcgggccagccgaatttggaagatgtaaatctcccagctcacagcacggaatgctttatttgaaagtattgctatgtagacagccggcttttctgtcatctaacctgctctccccaggttggctgaaggatgggagcggctgtgcctgcctgtgaggtcacagcatgaagtccttttaacttgctttctgctgcaggagagaggcgtattgtggtataactgttgctgtatttattcaaatggacaatttgcaatagatattatacccaggacgacagataagtcaacacataaggtgtttaaaattatccaactgccatagagctaaattcttttttggaaaattgaaccgaacttctactgaatacaagatgaaaatgtggttgctggtcagtcatcttgtgataatatctattactacctgtttagcagagtttacatggtatagaagatatggtcatggagtttctgaggaagacaaaggatttggaccaatttttgaagagcagccaatcaataccatttatccagaggaatcactggaaggaaaagtctcactcaactgtagggcacgagccagccctttcccggtttacaaatggagaatgaataatggggacgttgatctcacaagtgatcgatacagtatggtaggaggaaaccttgttatcaacaaccctgacaaacagaaagatgctggaatatactactgtttagcatctaataactacgggatggtcagaagcactgaagcaaccctgagctttggatatcttgatcctttcccacctgaggaacgtcctgaggtcagagtaaaagaagggaaaggaatggtgcttctctgtgaccccccataccattttccagatgatcttagctatcgctggcttctaaatgaatttcctgtatttatcacaatggataaacggcgatttgtgtctcagacaaatggcaatctctacattgcaaatgttgaggcttccgacaaaggcaattattcctgctttgtttccagtccttctattacaaagagcgtgttcagcaaattcatcccactcattccaatacctgaacgaacaacaaaaccatatcctgctgatattgtagttcagttcaaggatgtatatgcattgatgggccaaaatgtgaccttagaatgttttgcacttggaaatcctgttccggatatccgatggcggaaggttctagaaccaatgccaagcactgctgagattagcacctctggggctgttcttaagatcttcaatattcagctagaagatgaaggcatctatgaatgtgaggctgagaacattagaggaaaggataaacatcaagcaagaatttatgttcaagcattccctgagtgggtagaacacatcaatgacacagaggtggacataggcagtgatctctactggccttgtgtggccacaggaaagcccatccctacaatccgatggttgaaaaatggatatgcgtatcataaaggggaattaagactgtatgatgtgacttttgaaaatgccggaatgtatcagtgcatagctgaaaacacatatggagccatttatgcaaatgctgagttgaagatcttggcgttggctccaacttttgaaatgaatcctatgaagaaaaagatcctggctgctaaaggtggaagggtgataattgaatgcaaacctaaagctgcaccgaaaccaaagttttcatggagtaaagggacagagtggcttgtcaatagcagcagaatactcatttgggaagatggtagcttggaaatcaacaacattacaaggaatgatggaggtatctatacatgctttgcagaaaataacagagggaaagctaatagcactggaacccttgttatcacagatcctacgcgaattatattggccccaattaatgccgatatcacagttggagaaaacgccaccatgcagtgtgctgcgtcctttgatcctgccttggatctcacatttgtttggtccttcaatggctatgtgatcgattttaacaaagagaatattcactaccagaggaattttatgctggattccaatggggaattactaatccgaaatgcgcagctgaaacatgctggaagatacacatgcactgcccagacaattgtggacaattcttcagcttcagctgaccttgtagtgagaggtaaaaacagaaaaggtggagagaaaaacatggtggattcctttctccccgtctgtgcaagcctgcctccaacctggtgatcgttgacactcaccatttctgtgaaagacttttttttttttaacatattatactagatttgactaactcaatcttgtagcttctgcagttctccccacccccaacctagttcttagagtatgtttccccttttgaaacatgtaaacatactttgggcataaatattttttaaaatataactataatgcttcactaataccttaaaaatgcctagtgaactaactcagtacattatataatggccaagtgaaagttttgtgttttcatgtcctgtttttctttgaaattatatagcccagaaattagctcattatctgaaaaacgtatgaagaactgatgaattgtataatacaggagtattgccattgaatgtactgtttgatttattcaagcaggtaatgaacaatgttgtcaaactctctaatgagacatcataattaggacataagctaaaaggggcattactccggcagtctttttttcttaatcctagtaccatacatattctttggcatgaaagaatgaaaagcattagtaaacaactgaagtcctaccatggctctgtagggtttttggaacaattcctggaattggaaagtgaaaatggatagcatgtgggggaaaccctcatctgagtagcaagattttagtaaagatgactaagccattaacagcatgcattcatatttaattttattgactcctgccatcagcttttgtagatcgtttgggtggaaggttgtgatttttactgggaggacttgagtagaagtggatgattaaaattgaggagtatataattctttctgggactgcttaaatgttattgtttgaaaataccttcactttccccctttggtcaaagagatgtgcttaaaattcttattccttcacaataaataattttgattttcttagacaggtttgtgtttaggtatgagtttctcttttacttcatctagcaattctctctgtggtcagaagaactctgaagaaagctttgagggaaatgaatataactcttaaattattatatgtgtgtgtatatatatagtttaactttaaaaataatttattagtcatcataaagaaataaatgtctctggctcaagatgttacttatttccttcttttatattttctagtctcaattactgttccaaaaggagctatcttagaacttagactagagatccagattaa

SEQ ID NO: 32 - DNA, 5664 bp, Artificial Sequence
  CNTN1
cttctgctgtcaagtagccagggtgggctccgccgaggcgaggaggggcgccggtggggagatgcgctcccaggtgtttgcagcggaagtgggaaacctgtagggtatggtccagctgtgccgcaccgaggcgagcaggagcagggaacaggtgtttaaaattatccaactgccatagagctaaattcttttttggaaaattgaaccgaacttctactgaatacaagatgaaaatgtggttgctggtcagtcatcttgtgataatatctattactacctgtttagcagagtttacatggtatagaagatatggtcatggagtttctgaggaagacaaaggatttggaccaatttttgaagagcagccaatcaataccatttatccagaggaatcactggaaggaaaagtctcactcaactgtagggcacgagccagccctttcccggtttacaaatggagaatgaataatggggacgttgatctcacaagtgatcgatacagtatggtaggaggaaaccttgttatcaacaaccctgacaaacagaaagatgctggaatatactactgtttagcatctaataactacgggatggtcagaagcactgaagcaaccctgagctttggatatcttgatcctttcccacctgaggaacgtcctgaggtcagagtaaaagaagggaaaggaatggtgcttctctgtgaccccccataccattttccagatgatcttagctatcgctggcttctaaatgaatttcctgtatttatcacaatggataaacggcgatttgtgtctcagacaaatggcaatctctacattgcaaatgttgaggcttccgacaaaggcaattattcctgctttgtttccagtccttctattacaaagagcgtgttcagcaaattcatcccactcattccaatacctgaacgaacaacaaaaccatatcctgctgatattgtagttcagttcaaggatgtatatgcattgatgggccaaaatgtgaccttagaatgttttgcacttggaaatcctgttccggatatccgatggcggaaggttctagaaccaatgccaagcactgctgagattagcacctctggggctgttcttaagatcttcaatattcagctagaagatgaaggcatctatgaatgtgaggctgagaacattagaggaaaggataaacatcaagcaagaatttatgttcaagcattccctgagtgggtagaacacatcaatgacacagaggtggacataggcagtgatctctactggccttgtgtggccacaggaaagcccatccctacaatccgatggttgaaaaatggatatgcgtatcataaaggggaattaagactgtatgatgtgacttttgaaaatgccggaatgtatcagtgcatagctgaaaacacatatggagccatttatgcaaatgctgagttgaagatcttggcgttggctccaacttttgaaatgaatcctatgaagaaaaagatcctggctgctaaaggtggaagggtgataattgaatgcaaacctaaagctgcaccgaaaccaaagttttcatggagtaaagggacagagtggcttgtcaatagcagcagaatactcatttgggaagatggtagcttggaaatcaacaacattacaaggaatgatggaggtatctatacatgctttgcagaaaataacagagggaaagctaatagcactggaacccttgttatcacagatcctacgcgaattatattggccccaattaatgccgatatcacagttggagaaaacgccaccatgcagtgtgctgcgtcctttgatcctgccttggatctcacatttgtttggtccttcaatggctatgtgatcgattttaacaaagagaatattcactaccagaggaattttatgctggattccaatggggaattactaatccgaaatgcgcagctgaaacatgctggaagatacacatgcactgcccagacaattgtggacaattcttcagcttcagctgaccttgtagtgagaggccctccaggccctccaggtggtctgagaatagaagacattagagccacttctgtggcacttacttggagccgtggttcagacaatcatagtcctatttctaaatacactatccagaccaagactattctttcagatgactggaaagatgcaaagacagatcccccaattattgaaggaaatatggaggcagcaagagcagtggacttaatcccatggatggagtatgaattccgcgtggtagcaaccaatacactgggtagaggagagcccagtataccatctaacagaattaaaacagacggtgctgcaccaaatgtggctccttcagatgtaggaggtggaggtggaagaaacagagagctgaccataacatgggcgcctttgtcaagagaataccactatggcaacaattttggttacatagtggcatttaagccatttgatggagaagaatggaaaaaagtcacagttactaatcctgatactggccgatatgtccataaagatgaaaccatgagcccttccactgcatttcaagttaaagtcaaggccttcaacaacaaaggagatggaccttacagcctagtagcagtcattaattcagcacaagacgctcccagtgaagccccaacagaagtaggtgtaaaagtcttatcatcttctgagatatctgttcattgggaacatgttttagaaaaaatagtggaaagctatcagattcggtattgggctgcccatgacaaagaagaagctgcaaacagagttcaagtcaccagccaagagtactcggccaggctcgagaaccttctgccagacacccagtattttatagaagtcggggcctgcaatagtgcagggtgtggacctccaagtgacatgattgaggctttcaccaagaaagcacctcctagccagcctccaaggatcatcagttcagtaaggtctggttcacgctatataatcacctgggatcatgtcgttgcactatcaaatgaatctacagtgacgggatataaggtactctacagacctgatggccagcatgatggcaagctgtattcaactcacaaacactccatagaagtcccaatccccagagatggagaatacgttgtggaggttcgcgcgcacagtgatggaggagatggagtggtgtctcaagtcaaaatttcaggtgcacccaccctatccccaagtcttctcggcttactgctgcctgcctttggcatccttgtctacttggaattctgaatgtgttgtgacagctgctgttcccatcccagctcagaagacacccttcaaccctgggatgaccacaattccttccaatttctgcggctccatcctaagccaaataaattatactttaacaaactattcaactgatttacaacacacatgatgactgaggcattcgggaaccccttcatccaaaagaataaacttttaaatggatataaatgatttttaactcgttccaatatgccttataaaccacttaacctgattctgtgacagttgcatgatttaacccaatgggacaagttacagtgttcaattcaatactataggctgtagagtgaaagtcaaatcaccatatacaggtgctttaaatttaataacaagttgtgaaatataatagagattgaaatgttggttgtatgtggtaaatgtaagagtaatacagtctcttgtactttcctcactgttttgggtactgcatattattgaatggcccctatcattcatgacatcttgagttttcttgaaaagacaatagagtgtaacaaatattttgtcagaaatcccattatcaaatcatgagttgaaagattttgactattgaaaaccaaattctagaacttactatcagtattcttattttcaaaggaaataattttctaaatatttgattttcagaatcagttttttaatagtaaagttaacataccatatagatttttttttacttttatattctactctgaagttattttatgcttttcttatcaatttcaaatctcaaaaatcacagctcttatctagagtatcataatattgctatatttgttcatatgtggagtgacaaattttgaaaagtagagtgcttccttttttattgagatgtgacagtctttacatggttaggaataagtgacagttaagtgaatatcacaattactagtatgttggtttttctgcttcattcctaagtattacgtttctttattgcagatgtcagatcaaaaagtcacctgtaggttgaaaaagctaccgtattccattttgtaaaaataacaataataataataataataattagttttaagctcatttcccacttcaatgcaatactgaaaactggctaaaaataccaaatcaatatactgctaatggtactttgaagagtatgcaaaactggaaggccaggaggaggcaaataatatgtctttccgatggtgtctcccaagtgttggtgctttgggtttttataagttgtgaaaaggaagatgcacatttcttcattctccatggtgtgcatggaaatgtgtttgagtgtggatgtaaaagaaatcgagtaataaagaattagctggcttgtgaaatagtgcagtgttggatgcttcaagaggtataatcctattttattagcacaaacttgctagctaattagagtttatctttttagaaaggacaccgtataggttcgtaaaaaatatttacaggaagcaaaatagatctattactactttaccgactttaccccctttctttaatttgtataatttttgtactatatatcgatgtgtaaatgtttagagtcttcattatgaaaatatcaataaatatttcattagtttacatttaactctggtataaaatgaaacttttaaaaataagtgaaatggatgatttcccagtggaagtatgtcaacagtcttaagatcattgccagatttcataaaatatttaagtatttgaaaaagaaacaaaatgtcttcatactttagggaaacgaataccctgtataccttctgtacaaatgtttgtgttttcattgttacactttggggttttacttttgcaatgtgacccatgttgggcatttttatataatcaacaactaaatcttttgccaaatgcatgcttgccttttattttctaatatatgataataacgagcaaaactggttagattttgcatgaaatggttctgaaaggtaagaggaaaacagactttggaggttgtttagttttgaatttctgacagagataaagtagtttaaaatctctcgtacactgataactcaagcttttcattttctcatacagttgtacagatttaactgggaccatcagttttaaactgttgtcaagctaactaataatcatctgctttaagacgcaagattctgaattaaactttatataggtatagatacatctgttgtttctttgtatttcaggaaaggtgatagtagttttatttgatactgataaatattgaattgattttttagttattttttatcattttttcaatggagtagtataggactgtgctttgtcctttttatgaatgaaaaaattagtataaagtaataaatgtcttatgttacccaagaaaaaa

SEQ ID NO: 33 - DNA, 5480 bp, Artificial Sequence
  CNTN1
gtgtttaaaattatccaactgccatagagctaaattcttttttggaaaattgaaccgaacttctactgaatacaagatgaaaatgtggttgctggtcagtcatcttgtgataatatctattactacctgtttagcagtttctgaggaagacaaaggatttggaccaatttttgaagagcagccaatcaataccatttatccagaggaatcactggaaggaaaagtctcactcaactgtagggcacgagccagccctttcccggtttacaaatggagaatgaataatggggacgttgatctcacaagtgatcgatacagtatggtaggaggaaaccttgttatcaacaaccctgacaaacagaaagatgctggaatatactactgtttagcatctaataactacgggatggtcagaagcactgaagcaaccctgagctttggatatcttgatcctttcccacctgaggaacgtcctgaggtcagagtaaaagaagggaaaggaatggtgcttctctgtgaccccccataccattttccagatgatcttagctatcgctggcttctaaatgaatttcctgtatttatcacaatggataaacggcgatttgtgtctcagacaaatggcaatctctacattgcaaatgttgaggcttccgacaaaggcaattattcctgctttgtttccagtccttctattacaaagagcgtgttcagcaaattcatcccactcattccaatacctgaacgaacaacaaaaccatatcctgctgatattgtagttcagttcaaggatgtatatgcattgatgggccaaaatgtgaccttagaatgttttgcacttggaaatcctgttccggatatccgatggcggaaggttctagaaccaatgccaagcactgctgagattagcacctctggggctgttcttaagatcttcaatattcagctagaagatgaaggcatctatgaatgtgaggctgagaacattagaggaaaggataaacatcaagcaagaatttatgttcaagcattccctgagtgggtagaacacatcaatgacacagaggtggacataggcagtgatctctactggccttgtgtggccacaggaaagcccatccctacaatccgatggttgaaaaatggatatgcgtatcataaaggggaattaagactgtatgatgtgacttttgaaaatgccggaatgtatcagtgcatagctgaaaacacatatggagccatttatgcaaatgctgagttgaagatcttggcgttggctccaacttttgaaatgaatcctatgaagaaaaagatcctggctgctaaaggtggaagggtgataattgaatgcaaacctaaagctgcaccgaaaccaaagttttcatggagtaaagggacagagtggcttgtcaatagcagcagaatactcatttgggaagatggtagcttggaaatcaacaacattacaaggaatgatggaggtatctatacatgctttgcagaaaataacagagggaaagctaatagcactggaacccttgttatcacagatcctacgcgaattatattggccccaattaatgccgatatcacagttggagaaaacgccaccatgcagtgtgctgcgtcctttgatcctgccttggatctcacatttgtttggtccttcaatggctatgtgatcgattttaacaaagagaatattcactaccagaggaattttatgctggattccaatggggaattactaatccgaaatgcgcagctgaaacatgctggaagatacacatgcactgcccagacaattgtggacaattcttcagcttcagctgaccttgtagtgagaggccctccaggccctccaggtggtctgagaatagaagacattagagccacttctgtggcacttacttggagccgtggttcagacaatcatagtcctatttctaaatacactatccagaccaagactattctttcagatgactggaaagatgcaaagacagatcccccaattattgaaggaaatatggaggcagcaagagcagtggacttaatcccatggatggagtatgaattccgcgtggtagcaaccaatacactgggtagaggagagcccagtataccatctaacagaattaaaacagacggtgctgcaccaaatgtggctccttcagatgtaggaggtggaggtggaagaaacagagagctgaccataacatgggcgcctttgtcaagagaataccactatggcaacaattttggttacatagtggcatttaagccatttgatggagaagaatggaaaaaagtcacagttactaatcctgatactggccgatatgtccataaagatgaaaccatgagcccttccactgcatttcaagttaaagtcaaggccttcaacaacaaaggagatggaccttacagcctagtagcagtcattaattcagcacaagacgctcccagtgaagccccaacagaagtaggtgtaaaagtcttatcatcttctgagatatctgttcattgggaacatgttttagaaaaaatagtggaaagctatcagattcggtattgggctgcccatgacaaagaagaagctgcaaacagagttcaagtcaccagccaagagtactcggccaggctcgagaaccttctgccagacacccagtattttatagaagtcggggcctgcaatagtgcagggtgtggacctccaagtgacatgattgaggctttcaccaagaaagcacctcctagccagcctccaaggatcatcagttcagtaaggtctggttcacgctatataatcacctgggatcatgtcgttgcactatcaaatgaatctacagtgacgggatataaggtactctacagacctgatggccagcatgatggcaagctgtattcaactcacaaacactccatagaagtcccaatccccagagatggagaatacgttgtggaggttcgcgcgcacagtgatggaggagatggagtggtgtctcaagtcaaaatttcaggtgcacccaccctatccccaagtcttctcggcttactgctgcctgcctttggcatccttgtctacttggaattctgaatgtgttgtgacagctgctgttcccatcccagctcagaagacacccttcaaccctgggatgaccacaattccttccaatttctgcggctccatcctaagccaaataaattatactttaacaaactattcaactgatttacaacacacatgatgactgaggcattcgggaaccccttcatccaaaagaataaacttttaaatggatataaatgatttttaactcgttccaatatgccttataaaccacttaacctgattctgtgacagttgcatgatttaacccaatgggacaagttacagtgttcaattcaatactataggctgtagagtgaaagtcaaatcaccatatacaggtgctttaaatttaataacaagttgtgaaatataatagagattgaaatgttggttgtatgtggtaaatgtaagagtaatacagtctcttgtactttcctcactgttttgggtactgcatattattgaatggcccctatcattcatgacatcttgagttttcttgaaaagacaatagagtgtaacaaatattttgtcagaaatcccattatcaaatcatgagttgaaagattttgactattgaaaaccaaattctagaacttactatcagtattcttattttcaaaggaaataattttctaaatatttgattttcagaatcagttttttaatagtaaagttaacataccatatagatttttttttacttttatattctactctgaagttattttatgcttttcttatcaatttcaaatctcaaaaatcacagctcttatctagagtatcataatattgctatatttgttcatatgtggagtgacaaattttgaaaagtagagtgcttccttttttattgagatgtgacagtctttacatggttaggaataagtgacagttaagtgaatatcacaattactagtatgttggtttttctgcttcattcctaagtattacgtttctttattgcagatgtcagatcaaaaagtcacctgtaggttgaaaaagctaccgtattccattttgtaaaaataacaataataataataataataattagttttaagctcatttcccacttcaatgcaatactgaaaactggctaaaaataccaaatcaatatactgctaatggtactttgaagagtatgcaaaactggaaggccaggaggaggcaaataatatgtctttccgatggtgtctcccaagtgttggtgctttgggtttttataagttgtgaaaaggaagatgcacatttcttcattctccatggtgtgcatggaaatgtgtttgagtgtggatgtaaaagaaatcgagtaataaagaattagctggcttgtgaaatagtgcagtgttggatgcttcaagaggtataatcctattttattagcacaaacttgctagctaattagagtttatctttttagaaaggacaccgtataggttcgtaaaaaatatttacaggaagcaaaatagatctattactactttaccgactttaccccctttctttaatttgtataatttttgtactatatatcgatgtgtaaatgtttagagtcttcattatgaaaatatcaataaatatttcattagtttacatttaactctggtataaaatgaaacttttaaaaataagtgaaatggatgatttcccagtggaagtatgtcaacagtcttaagatcattgccagatttcataaaatatttaagtatttgaaaaagaaacaaaatgtcttcatactttagggaaacgaataccctgtataccttctgtacaaatgtttgtgttttcattgttacactttggggttttacttttgcaatgtgacccatgttgggcatttttatataatcaacaactaaatcttttgccaaatgcatgcttgccttttattttctaatatatgataataacgagcaaaactggttagattttgcatgaaatggttctgaaaggtaagaggaaaacagactttggaggttgtttagttttgaatttctgacagagataaagtagtttaaaatctctcgtacactgataactcaagcttttcattttctcatacagttgtacagatttaactgggaccatcagttttaaactgttgtcaagctaactaataatcatctgctttaagacgcaagattctgaattaaactttatataggtatagatacatctgttgtttctttgtatttcaggaaaggtgatagtagttttatttgatactgataaatattgaattgattttttagttattttttatcattttttcaatggagtagtataggactgtgctttgtcctttttatgaatgaaaaaattagtataaagtaataaatgtcttatgttacccaagaaaaaa

SEQ ID NO: 34 - DNA, 5817 bp, Artificial Sequence
  CNTN1
agcattgactccagccagccaggttcgggaatgtaaatccacagctcacagcccagaatgctttatttgaaagtatcgctatgtggagatccagctttgcagtcttataacctgttctttgcagaaggttggctgaaggatgggagcggctatgcctgcctctgaggtcacagcatgaggtccttttaacttgccttctgctgcagaagagaagcccattgtgtcataactctccctgagtctattcaaaggggcaatttgaagcagatattatagcaagatcggcagatgattcaacccacacggtctttcatagtactcaactgccataaagctttcattacttttggaaactgacccatctattcaacaaaagatgaaaatgccattgctggtcagccatctcctgctaatctccttaacatcttgtctaggagactttacctggcacagaagatatggtcatggagtgtctgaggaggacaaaggatttgggcccatttttgaagagcagccaatcaataccatttacccagaagagtcactggaaggaaaagtgtcactcaactgccgggcacgcgccagcccatttccagtttacaaatggagaatgaataacggggacgtggacctgacaaacgatcggtacagtatggtcggaggaaaccttgttatcaacaacccggacaaacagaaagacgctggggtgtactactgcctggcatccaacaactacggaatggtcaggagcacggaggcaactctgagcttcgggtatctcgacccctttcctcccgaggagcgtccggaagtgaaggtgaaggaagggaagggcatggtgcttctctgtgatcctccctaccacttcccagatgatcttagctaccgctggcttctgaatgaatttcctgtatttatcaccatggataagcgaagatttgtgtctcagaccaacggcaatctctacatcgcaaatgtcgagtcttctgacagaggcaactactcctgctttgtgtccagtccttctattacaaagagtgtgttcagcaagtttattcccctcattccgattcctgaacgaacaacaaagccatatcctgctgatattgtggtgcagttcaaggacatatacaccatgatgggccaaaatgtgactttagagtgtttcgctctagggaaccctgttcctgatatccggtggcggaaggtgctagaaccaatgcccagcactgctgagataagcacgtcaggggctgtcctcaagatcttcaacatccagctagaagatgaaggcctctacgagtgtgaggctgagaacatccggggaaaggacaagcaccaggcaagaatctatgttcaagcgtttcctgagtgggtagagcatatcaatgacactgaggtggacataggcagtgacctctactggccttgcatagccacagggaagcccattcctaccatcaggtggctgaaaaatggatactcgtatcacaaaggggaactgagactgtatgatgtgacttttgaaaatgccgggatgtaccagtgcatagcagaaaacgcgtatgggtccatttatgccaacgctgagctcaagatcctggctttagctccaacttttgaaatgaatcctatgaagaaaaagatcttggctgcgaaaggtggaagggttatcattgaatgtaaacccaaggccgcaccaaaacccaagttttcatggagcaaagggacggagtggctcgttaacagcagcagaatactcatatgggaagatggtagcttggaaatcaataatattacaagaaatgatggtggaatctatacatgctttgcagaaaataacagaggaaaagctaatagcactgggactctggtgatcacaaatcccacacgaattattttggccccaatcaatgctgacatcactgttggggaaaatgccaccatgcagtgtgctgcgtctttcgatcctgccttggacctcacgtttgtgtggtccttcaatggctacgtgattgactttaacaaggaaattacgcatatccattaccagaggaattttatgctcgacgccaatggggaactgctcatccgaaatgcgcagctgaaacacgcaggccggtacacgtgcacggcgcagacaatcgtggacaattcctcggcttccgctgaccttgtcgttcgaggccccccaggtcccccaggaggcctgagaatagaagacatcagagctacctctgtggcactgacttggagccgtggttccgacaatcacagccctatctctaaatacacgatccagaccaagacgattctctcagatgactggaaagatgcgaagacagatcccccaatcattgaaggaaacatggagtcagcaaaagcagtggatttgatcccttggatggagtatgaatttcgagtggtggcgaccaatactttagggacaggagagcccagcataccctcaaacaggatcaaaacagacggtgctgcaccaaatgtggctccctcagatgtaggcggtgggggcggaaccaacagagagctgacaataacgtgggcgcctttgtcgagagagtaccattacggtaacaattttggttacatagtggcgtttaagccatttgatggagaagagtggaagaaagtgactgtgactaacccagacactggccgctacgtccacaaagatgagaccatgaccccctccaccgcgtttcaagtcaaagtgaaagccttcaacaataaaggagatgggccctacagcctcgtagctgtcatcaactctgcacaagatgctcccagtgaagcccccacagaggtaggggtcaaagtgttatcatcctctgagatatctgtccattggaagcatgtgttagagaaaattgtggaaagctatcagattcggtactgggctgggcatgacaaagaagcagccgcacacagagttcaggtcaccagccaggagtactcagccagactggagaaccttcttcccgacacccagtacttcattgaagtgggagcctgcaacagtgccggatgcggaccttccagtgatgtgatcgagaccttcaccagaaaagcccctcctagccaaccaccaaggatcatcagttcggtgagatctggctcacgatatataatcacatgggatcacgttgtggcactatccaatgaatctactgtgacaggctacaagatactctatagaccggatggccaacatgacggcaagctgttctcaacccataaacactccatagaagtccccatccccagagacggagagtatgttgtcgaggttcgagcacacagcgacgggggagacggagtcgtgtctcaagtcaaaatttcaggcgtgtccacgctgtcttcgagtctcctcagcttgctcctgccctcccttggctttcttgtctactcggaattctgaatgttacgaccttggctgttttcatccctgctcagaggatgctcttcatcatgggatgactgtaattccttctaatccctgcggctccatcctaagccaaacaaattagactctaacaagctgttcaactgatttcccaacacatcacgactgaggcattcaggaaccccttcatccaaaagaataactttcaagtggaaataaagtgatttttaactcgttccaatatgccttataaaccatttaacctgattctgtgaaagttgcatgacttaaatcaatggacaagttacagtgttcaattcaatgccctaggctgtagagtgaaggtcaccatacacaggtgctttacatgtttgacaagttgtgaaatataatagagattgaaatgttgattgtatgtagtatgtgttcgagtaatgcagtctcttgtattagcctatatgtttgggttcctgcctatttttgaaagaccctcatcattcatgatattttgagttttccataaaattaaaacaaaaaaaatagaaaaaaaatcattttgacataaacaccattaccaaatcactttactgaatgagttggaagtttttgactatgaaaaccaaattatagaacttactattatcagtattcttatttttgatgtaattttctacacatttgcttttcagaatccctaatactcttcagttagttttctaatgctgacgttcccatgccacgtgaggatttttttttttttttttacttttgtattctaatctgaaattgttttgtgcttttcttctcatcaatgtcaaaccacagaagctgcagcgcatctggaacattgtctactgctgtgtttattcatgtgtggaatgacaggtttggggaagtagagcgctttcatttatactgcaatgcgatcgtctttatccagctagaaacaagtgacagtaaagtatcagaatctctgaatgttctcattgttctggttttgtgcttcatgcctaagtataaactctctttacaagaaggtgtagagtcaagaattcatatgcaggtttggaaaaagctacagaattccatttcaagaagtttaaagctcgtttcccatttcaatgcaatactgaaaactggctaaaaataccaaatcagaatgttgctaagtggtcctatgaagaatatgcaaagctgggaggcaggcgaggtcggcagtgtcctgcgcgaggatgtctcccaagtgctgttgtgaaggaatttgtgaggtgtgaaagggaaacctgtgtttcctcattgtccatggtgtgcccagagatgtgtctgagtgtgggtgtggaagaactcgggtaataaagaattagctggctcctggagcagtgcaatgtttggttccttgagaaatcgaatcctattttattagcacaatcttgctggctaattagagacagagtttatctttttagaaaagataccctataggtccataaagaatatttacaggaaacaaaaatagatctattaatatgttacccctatctttaatttgtataatttttgtactatatgtgtaaaggtttaaagtcctcattatgaaaatatcaataaatatttcattaatttacacttaacactttgttatacaaatgaaactttttaaatcggtaaaacagatgctctcccagtagaagcatgtcaacaaaccatcgccaggtttcataaaatatttaatgatttgcaaaagaagaaaatgacttcatactttagggagatgaacactctgtaagctttctgtacaaacgttgtgttttccttgttatattcgggggttttcctcttgcgatgtgacccatgttgggcatttttgtatcatcaattaacaactacatcttttgccaaatgcatgcctgccttttccgttctaatatgtggtaataaagaccaaaactggctagattttgcatgaaaatggttctgaaagataagaaaacagactttgaaggttgtttagtttaaatatgtggcggatagactcaactctctcatgcacaaatgacttctgcttttcatttcctcatataattgtacagatgtgactgggaccatcagttttaaactgttgtcaagctaaccaatgtatcacatgctttaagatgcaagataattaattaaactttatatagctctagacacatctgttgtttctttgtatttcaggaaaggtaatagtagtttcatttgatactgataaataacgaattgatttttttagttattttttatcattttcttcaatggagtagtataggactgtcgtttgtcctttttatgaatgaatacaaattataaagaaataaatgtcttactgttgcccaaaaagtaactgtcccttc

SEQ ID NO: 35 - DNA, 5671 bp, Artificial Sequence
  CNTN1
actctgaggccccggctactgctgtcaagtagctagggtgggctccgcctaagcgaggagtggcgctgggctggtgggagatgcgctcccagctgtttgcagcgggagcgggaaagctgtagggccaggcagcgaggaggcgacaggagtggggaacaggtctttcatagtactcaactgccataaagctttcattacttttggaaactgacccatctattcaacaaaagatgaaaatgccattgctggtcagccatctcctgctaatctccttaacatcttgtctaggagactttacctggcacagaagatatggtcatggagtgtctgaggaggacaaaggatttgggcccatttttgaagagcagccaatcaataccatttacccagaagagtcactggaaggaaaagtgtcactcaactgccgggcacgcgccagcccatttccagtttacaaatggagaatgaataacggggacgtggacctgacaaacgatcggtacagtatggtcggaggaaaccttgttatcaacaacccggacaaacagaaagacgctggggtgtactactgcctggcatccaacaactacggaatggtcaggagcacggaggcaactctgagcttcgggtatctcgacccctttcctcccgaggagcgtccggaagtgaaggtgaaggaagggaagggcatggtgcttctctgtgatcctccctaccacttcccagatgatcttagctaccgctggcttctgaatgaatttcctgtatttatcaccatggataagcgaagatttgtgtctcagaccaacggcaatctctacatcgcaaatgtcgagtcttctgacagaggcaactactcctgctttgtgtccagtccttctattacaaagagtgtgttcagcaagtttattcccctcattccgattcctgaacgaacaacaaagccatatcctgctgatattgtggtgcagttcaaggacatatacaccatgatgggccaaaatgtgactttagagtgtttcgctctagggaaccctgttcctgatatccggtggcggaaggtgctagaaccaatgcccagcactgctgagataagcacgtcaggggctgtcctcaagatcttcaacatccagctagaagatgaaggcctctacgagtgtgaggctgagaacatccggggaaaggacaagcaccaggcaagaatctatgttcaagcgtttcctgagtgggtagagcatatcaatgacactgaggtggacataggcagtgacctctactggccttgcatagccacagggaagcccattcctaccatcaggtggctgaaaaatggatactcgtatcacaaaggggaactgagactgtatgatgtgacttttgaaaatgccgggatgtaccagtgcatagcagaaaacgcgtatgggtccatttatgccaacgctgagctcaagatcctggctttagctccaacttttgaaatgaatcctatgaagaaaaagatcttggctgcgaaaggtggaagggttatcattgaatgtaaacccaaggccgcaccaaaacccaagttttcatggagcaaagggacggagtggctcgttaacagcagcagaatactcatatgggaagatggtagcttggaaatcaataatattacaagaaatgatggtggaatctatacatgctttgcagaaaataacagaggaaaagctaatagcactgggactctggtgatcacaaatcccacacgaattattttggccccaatcaatgctgacatcactgttggggaaaatgccaccatgcagtgtgctgcgtctttcgatcctgccttggacctcacgtttgtgtggtccttcaatggctacgtgattgactttaacaaggaaattacgcatatccattaccagaggaattttatgctcgacgccaatggggaactgctcatccgaaatgcgcagctgaaacacgcaggccggtacacgtgcacggcgcagacaatcgtggacaattcctcggcttccgctgaccttgtcgttcgaggccccccaggtcccccaggaggcctgagaatagaagacatcagagctacctctgtggcactgacttggagccgtggttccgacaatcacagccctatctctaaatacacgatccagaccaagacgattctctcagatgactggaaagatgcgaagacagatcccccaatcattgaaggaaacatggagtcagcaaaagcagtggatttgatcccttggatggagtatgaatttcgagtggtggcgaccaatactttagggacaggagagcccagcataccctcaaacaggatcaaaacagacggtgctgcaccaaatgtggctccctcagatgtaggcggtgggggcggaaccaacagagagctgacaataacgtgggcgcctttgtcgagagagtaccattacggtaacaattttggttacatagtggcgtttaagccatttgatggagaagagtggaagaaagtgactgtgactaacccagacactggccgctacgtccacaaagatgagaccatgaccccctccaccgcgtttcaagtcaaagtgaaagccttcaacaataaaggagatgggccctacagcctcgtagctgtcatcaactctgcacaagatgctcccagtgaagcccccacagaggtaggggtcaaagtgttatcatcctctgagatatctgtccattggaagcatgtgttagagaaaattgtggaaagctatcagattcggtactgggctgggcatgacaaagaagcagccgcacacagagttcaggtcaccagccaggagtactcagccagactggagaaccttcttcccgacacccagtacttcattgaagtgggagcctgcaacagtgccggatgcggaccttccagtgatgtgatcgagaccttcaccagaaaagcccctcctagccaaccaccaaggatcatcagttcggtgagatctggctcacgatatataatcacatgggatcacgttgtggcactatccaatgaatctactgtgacaggctacaagatactctatagaccggatggccaacatgacggcaagctgttctcaacccataaacactccatagaagtccccatccccagagacggagagtatgttgtcgaggttcgagcacacagcgacgggggagacggagtcgtgtctcaagtcaaaatttcaggcgtgtccacgctgtcttcgagtctcctcagcttgctcctgccctcccttggctttcttgtctactcggaattctgaatgttacgaccttggctgttttcatccctgctcagaggatgctcttcatcatgggatgactgtaattccttctaatccctgcggctccatcctaagccaaacaaattagactctaacaagctgttcaactgatttcccaacacatcacgactgaggcattcaggaaccccttcatccaaaagaataactttcaagtggaaataaagtgatttttaactcgttccaatatgccttataaaccatttaacctgattctgtgaaagttgcatgacttaaatcaatggacaagttacagtgttcaattcaatgccctaggctgtagagtgaaggtcaccatacacaggtgctttacatgtttgacaagttgtgaaatataatagagattgaaatgttgattgtatgtagtatgtgttcgagtaatgcagtctcttgtattagcctatatgtttgggttcctgcctatttttgaaagaccctcatcattcatgatattttgagttttccataaaattaaaacaaaaaaaatagaaaaaaaatcattttgacataaacaccattaccaaatcactttactgaatgagttggaagtttttgactatgaaaaccaaattatagaacttactattatcagtattcttatttttgatgtaattttctacacatttgcttttcagaatccctaatactcttcagttagttttctaatgctgacgttcccatgccacgtgaggatttttttttttttttttacttttgtattctaatctgaaattgttttgtgcttttcttctcatcaatgtcaaaccacagaagctgcagcgcatctggaacattgtctactgctgtgtttattcatgtgtggaatgacaggtttggggaagtagagcgctttcatttatactgcaatgcgatcgtctttatccagctagaaacaagtgacagtaaagtatcagaatctctgaatgttctcattgttctggttttgtgcttcatgcctaagtataaactctctttacaagaaggtgtagagtcaagaattcatatgcaggtttggaaaaagctacagaattccatttcaagaagtttaaagctcgtttcccatttcaatgcaatactgaaaactggctaaaaataccaaatcagaatgttgctaagtggtcctatgaagaatatgcaaagctgggaggcaggcgaggtcggcagtgtcctgcgcgaggatgtctcccaagtgctgttgtgaaggaatttgtgaggtgtgaaagggaaacctgtgtttcctcattgtccatggtgtgcccagagatgtgtctgagtgtgggtgtggaagaactcgggtaataaagaattagctggctcctggagcagtgcaatgtttggttccttgagaaatcgaatcctattttattagcacaatcttgctggctaattagagacagagtttatctttttagaaaagataccctataggtccataaagaatatttacaggaaacaaaaatagatctattaatatgttacccctatctttaatttgtataatttttgtactatatgtgtaaaggtttaaagtcctcattatgaaaatatcaataaatatttcattaatttacacttaacactttgttatacaaatgaaactttttaaatcggtaaaacagatgctctcccagtagaagcatgtcaacaaaccatcgccaggtttcataaaatatttaatgatttgcaaaagaagaaaatgacttcatactttagggagatgaacactctgtaagctttctgtacaaacgttgtgttttccttgttatattcgggggttttcctcttgcgatgtgacccatgttgggcatttttgtatcatcaattaacaactacatcttttgccaaatgcatgcctgccttttccgttctaatatgtggtaataaagaccaaaactggctagattttgcatgaaaatggttctgaaagataagaaaacagactttgaaggttgtttagtttaaatatgtggcggatagactcaactctctcatgcacaaatgacttctgcttttcatttcctcatataattgtacagatgtgactgggaccatcagttttaaactgttgtcaagctaaccaatgtatcacatgctttaagatgcaagataattaattaaactttatatagctctagacacatctgttgtttctttgtatttcaggaaaggtaatagtagtttcatttgatactgataaataacgaattgatttttttagttattttttatcattttcttcaatggagtagtataggactgtcgtttgtcctttttatgaatgaatacaaattataaagaaataaatgtcttactgttgcccaaaaagtaactgtcccttc

SEQ ID NO: 36 - protein, 627 aa, Artificial Sequence
  CNTN1
MKMWLLVSHLVIISITTCLAEFTWYRRYGHGVSEEDKGFGPIFEEQPINTIYPEESLEGKVSLNCRARASPFPVYKWRMNNGDVDLTSDRYSMVGGNLVINNPDKQKDAGIYYCLASNNYGMVRSTEATLSFGYLDPFPPEERPEVRVKEGKGMVLLCDPPYHFPDDLSYRWLLNEFPVFITMDKRRFVSQTNGNLYIANVEASDKGNYSCFVSSPSITKSVFSKFIPLIPIPERTTKPYPADIVVQFKDVYALMGQNVTLECFALGNPVPDIRWRKVLEPMPSTAEISTSGAVLKIFNIQLEDEGIYECEAENIRGKDKHQARIYVQAFPEWVEHINDTEVDIGSDLYWPCVATGKPIPTIRWLKNGYAYHKGELRLYDVTFENAGMYQCIAENTYGAIYANAELKILALAPTFEMNPMKKKILAAKGGRVIIECKPKAAPKPKFSWSKGTEWLVNSSRILIWEDGSLEINNITRNDGGIYTCFAENNRGKANSTGTLVITDPTRIILAPINADITVGENATMQCAASFDPALDLTFVWSFNGYVIDFNKENIHYQRNFMLDSNGELLIRNAQLKHAGRYTCTAQTIVDNSSASADLVVRGKNRKGGEKNMVDSFLPVCASLPPTW

SEQ ID NO: 37 - protein, 627 aa, Artificial Sequence; identical to SEQ ID NO: 36
  CNTN1

SEQ ID NO: 38 - protein, 1018 aa, Artificial Sequence
  CNTN1
MKMWLLVSHLVIISITTCLAEFTWYRRYGHGVSEEDKGFGPIFEEQPINTIYPEESLEGKVSLNCRARASPFPVYKWRMNNGDVDLTSDRYSMVGGNLVINNPDKQKDAGIYYCLASNNYGMVRSTEATLSFGYLDPFPPEERPEVRVKEGKGMVLLCDPPYHFPDDLSYRWLLNEFPVFITMDKRRFVSQTNGNLYIANVEASDKGNYSCFVSSPSITKSVFSKFIPLIPIPERTTKPYPADIVVQFKDVYALMGQNVTLECFALGNPVPDIRWRKVLEPMPSTAEISTSGAVLKIFNIQLEDEGIYECEAENIRGKDKHQARIYVQAFPEWVEHINDTEVDIGSDLYWPCVATGKPIPTIRWLKNGYAYHKGELRLYDVTFENAGMYQCIAENTYGAIYANAELKILALAPTFEMNPMKKKILAAKGGRVIIECKPKAAPKPKFSWSKGTEWLVNSSRILIWEDGSLEINNITRNDGGIYTCFAENNRGKANSTGTLVITDPTRIILAPINADITVGENATMQCAASFDPALDLTFVWSFNGYVIDFNKENIHYQRNFMLDSNGELLIRNAQLKHAGRYTCTAQTIVDNSSASADLVVRGPPGPPGGLRIEDIRATSVALTWSRGSDNHSPISKYTIQTKTILSDDWKDAKTDPPIIEGNMEAARAVDLIPWMEYEFRVVATNTLGRGEPSIPSNRIKTDGAAPNVAPSDVGGGGGRNRELTITWAPLSREYHYGNNFGYIVAFKPFDGEEWKKVTVTNPDTGRYVHKDETMSPSTAFQVKVKAFNNKGDGPYSLVAVINSAQDAPSEAPTEVGVKVLSSSEISVHWEHVLEKIVESYQIRYWAAHDKEEAANRVQVTSQEYSARLENLLPDTQYFIEVGACNSAGCGPPSDMIEAFTKKAPPSQPPRIISSVRSGSRYIITWDHVVALSNESTVTGYKVLYRPDGQHDGKLYSTHKHSIEVPIPRDGEYVVEVRAHSDGGDGVVSQVKISGAPTLSPSLLGLLLPAFGILVYLEF

SEQ ID NO: 39 - protein, 1007 aa, Artificial Sequence
  CNTN1
MKMWLLVSHLVIISITTCLAVSEEDKGFGPIFEEQPINTIYPEESLEGKVSLNCRARASPFPVYKWRMNNGDVDLTSDRYSMVGGNLVINNPDKQKDAGIYYCLASNNYGMVRSTEATLSFGYLDPFPPEERPEVRVKEGKGMVLLCDPPYHFPDDLSYRWLLNEFPVFITMDKRRFVSQTNGNLYIANVEASDKGNYSCFVSSPSITKSVFSKFIPLIPIPERTTKPYPADIVVQFKDVYALMGQNVTLECFALGNPVPDIRWRKVLEPMPSTAEISTSGAVLKIFNIQLEDEGIYECEAENIRGKDKHQARIYVQAFPEWVEHINDTEVDIGSDLYWPCVATGKPIPTIRWLKNGYAYHKGELRLYDVTFENAGMYQCIAENTYGAIYANAELKILALAPTFEMNPMKKKILAAKGGRVIIECKPKAAPKPKFSWSKGTEWLVNSSRILIWEDGSLEINNITRNDGGIYTCFAENNRGKANSTGTLVITDPTRIILAPINADITVGENATMQCAASFDPALDLTFVWSFNGYVIDFNKENIHYQRNFMLDSNGELLIRNAQLKHAGRYTCTAQTIVDNSSASADLVVRGPPGPPGGLRIEDIRATSVALTWSRGSDNHSPISKYTIQTKTILSDDWKDAKTDPPIIEGNMEAARAVDLIPWMEYEFRVVATNTLGRGEPSIPSNRIKTDGAAPNVAPSDVGGGGGRNRELTITWAPLSREYHYGNNFGYIVAFKPFDGEEWKKVTVTNPDTGRYVHKDETMSPSTAFQVKVKAFNNKGDGPYSLVAVINSAQDAPSEAPTEVGVKVLSSSEISVHWEHVLEKIVESYQIRYWAAHDKEEAANRVQVTSQEYSARLENLLPDTQYFIEVGACNSAGCGPPSDMIEAFTKKAPPSQPPRIISSVRSGSRYIITWDHVVALSNESTVTGYKVLYRPDGQHDGKLYSTHKHSIEVPIPRDGEYVVEVRAHSDGGDGVVSQVKISGAPTLSPSLLGLLLPAFGILVYLEF

SEQ ID NO: 40 - protein, 1020 aa, Artificial Sequence
  CNTN1
MKMPLLVSHLLLISLTSCLGDFTWHRRYGHGVSEEDKGFGPIFEEQPINTIYPEESLEGKVSLNCRARASPFPVYKWRMNNGDVDLTNDRYSMVGGNLVINNPDKQKDAGVYYCLASNNYGMVRSTEATLSFGYLDPFPPEERPEVKVKEGKGMVLLCDPPYHFPDDLSYRWLLNEFPVFITMDKRRFVSQTNGNLYIANVESSDRGNYSCFVSSPSITKSVFSKFIPLIPIPERTTKPYPADIVVQFKDIYTMMGQNVTLECFALGNPVPDIRWRKVLEPMPSTAEISTSGAVLKIFNIQLEDEGLYECEAENIRGKDKHQARIYVQAFPEWVEHINDTEVDIGSDLYWPCIATGKPIPTIRWLKNGYSYHKGELRLYDVTFENAGMYQCIAENAYGSIYANAELKILALAPTFEMNPMKKKILAAKGGRVIIECKPKAAPKPKFSWSKGTEWLVNSSRILIWEDGSLEINNITRNDGGIYTCFAENNRGKANSTGTLVITNPTRIILAPINADITVGENATMQCAASFDPALDLTFVWSFNGYVIDFNKEITHIHYQRNFMLDANGELLIRNAQLKHAGRYTCTAQTIVDNSSASADLVVRGPPGPPGGLRIEDIRATSVALTWSRGSDNHSPISKYTIQTKTILSDDWKDAKTDPPIIEGNMESAKAVDLIPWMEYEFRVVATNTLGTGEPSIPSNRIKTDGAAPNVAPSDVGGGGGTNRELTITWAPLSREYHYGNNFGYIVAFKPFDGEEWKKVTVTNPDTGRYVHKDETMTPSTAFQVKVKAFNNKGDGPYSLVAVINSAQDAPSEAPTEVGVKVLSSSEISVHWKHVLEKIVESYQIRYWAGHDKEAAAHRVQVTSQEYSARLENLLPDTQYFIEVGACNSAGCGPSSDVIETFTRKAPPSQPPRIISSVRSGSRYIITWDHVVALSNESTVTGYKILYRPDGQHDGKLFSTHKHSIEVPIPRDGEYVVEVRAHSDGGDGVVSQVKISGVSTLSSSLLSLLLPSLGFLVYSEF

SEQ ID NO: 41 - protein, 1020 aa, Artificial Sequence; identical to SEQ ID NO: 40
  CNTN1

SEQ ID NO: 42 - protein, 1020 aa, Artificial Sequence; identical to SEQ ID NO: 40
  CNTN1

SEQ ID NO: 43 - DNA, 4070 bp, Artificial Sequence
  PCSK1
tttgtgggacagccatgaggaggtgcatcaccagagggctgcttggagggtctttctgaaagctggcataagaatgctggatggcattgtgacggatgctattgaggccagttcaattggattcaatcctggacacgtggatatttacagtgcaagctggggccctaatgatgatgggaaaactgtggaggggcctggccggctagcccagaaggcttttgaatatggtgtcaaacagacgagcgctgacctgcacaatgactgcacggagacgcacacaggcacctcggcctctgcacctctggctgctggcatcttcgctctggccctggaagcaaacccaaatctcacctggcgagatatgcagcacctggttgtctggacctctgagtatgacccgctggccaataaccctggatggaaaaagaatggagcaggcttgatggtgaatagtcgatttggatttggcttgctaaatgccaaagctctggtggatttagctgaccccaggacctggaggagcgtgcctgagaagaaagagtgtgttgtaaaggacaatgactttgagcccagagccctgaaagctaatggagaagttatcattgaaattccaacaagagcttgtgaaggacaagaaaatgctatcaagtccctggagcatgtacaatttgaagcaacaattgaatattcccgaagaggagaccttcatgtcacacttacttctgctgctggaactagcactgtgctcttggctgaaagagaacgggatacatctcctaatggctttaagaattgggacttcatgtctgttcacacatggggagagaaccctataggtacttggactttgagaattacagacatgtctggaagaattcaaaatgaaggaagaattgtgaactggaagctgattttgcacgggacctcttctcagccagagcatatgaagcagcctcgtgtgtacacgtcctacaacactgttcagaatgacagaagaggggtggagaagatggtggatccaggggaggagcagcccacacaagagaaccctaaggagaacaccctggtgtccaaaagccccagcagcagcagcgtagggggccggagggatgagttggaggagggagccccttcccaggccatgctgcgactcctgcaaagtgctttcagtaaaaactcaccgccaaagcaatcaccaaagaagtccccaagtgcaaagctcaacatcccttatgaaaacttctacgaagccctggaaaagctgaacaaaccttcccagcttaaagactctgaagacagtctgtataatgactatgttgatgttttttataacactaaaccttacaagcacagagacgaccggctgcttcaagctctggtggacattctgaatgaggaaaattaaaataagtgtgtggtcccaagttggaaatattcatgcttcttccttaccctgcgattttgcctgtgtctgaagtggttgttttgtcatgaattcttatgcttataatatcctttgtggcaccttttctttttctccctaaactgtacatgtgaaggggatgagctcaagcaggaagttcaacttccagaattgatcataggtatttcaaaacacatctttcctgtctgcacaagtgaagtgttttgttctttctggagtcacagttgacaaaaagctcttacactacattagaacactgcattagagcccatttcaattctcaaaagaaaaggcaaaacctgggatatcaattaatttgaaaacataatctgcaaagaatgagaaggagtcagaaactgtttctgtagcttgttccctgtcttgtccatgtggttcttcaaattttgatgccaagaaagtatttggtaggcctaatgaaggagttcactgtaagactcattccctagatctttctattccaaagtgccactcattcctgtagtcaaaatctggtcatgttggtcaaaagctggattatttagatctagaaacagatcttgaaatctgaatgctctggtttgagcaattttcgaacattctttgcctggtgcactgtgtctgtggtgccagaggcgtccgtggatccagaggtggttatgactcgtgctgcatgcctggtctttcctctgtttctccttctgaaagttttctatacctgtctcctttctcagccacaaaataaatgttgggagaaatgatatataccactttcccagaaaaaaaaaaacttacacttgggacttggcaaattcctagtcacaatttttttcagcagtaacaggaaaccacttatcacatggagacctaatgtaataatagaaaaatactcataatagggagaaaccaagagaagttttgtttttgtttttttccaactgtgttcattagaacagcgtgttctaagtatttgaaactgaatgtttattccttgatactaaaagttcttctccaatcctatcactgatagtgtccaaattctcaccaaattgctcctaagcttcaaatcagaagcagaaactggcaggccatggaccttaattgtccctcaggtagattttgtttggtatgcagaatgtttttaaaatatgagtggttattgaaaatatgatgtttcacataaaacctcattctcggacccatctttgctcatggcaacagttagctggagctgagtagcagctgcctgattagatgactctcagtccccatggcaccctgctccatgttacctagagcaggcacttgattccttgctgggcagtatccaataggcatttgattttgcccactcctacactaagcgaatgtgtacaaagtgtaaatgcattaggaaaaacaaactacccgcatcttctgttaggcaggatctgtacaataataattatgagtttgcttatgtaatctcacctcacctggatgatcactaatactaattcatttattactaaccttctggcttccttctctcaatatgcttacaaagtctccagtcacctacaatgctggctttctcccactgagtttgctgtttgcaatttttccatgaagtttgaacttcataaggtaattcatggcattgaactggttcatgaaaagaacactagagtctgtcatttgctttggcttgaagtatggttggtaacacaaattttcacctgctcttctaccatttgaatttgtgtagagggtgtttgcagagcaatgcccgtaatgcttagagaatgttctcctaaaagacttgcggaatcactctgtccttggaagtttcatatattgtttgatatgaagtgttagatagaatttccaatattggagcatatcaaaaagtattaaaactaaaaaggaccagagaattcttagattggcccggaaaggccaataaagagttagaatgaaaactcattacttttccattcccaatctagtgctagatgtataaatctttcttttgattcttcctaacaaaatattttctgggttaaaaccccagccaactcattgggttgtagccaaaggttcactctcaagaagctttaatatttaaataaaatcatattgaatgtttccaacctggagtataatattcagatataaaacagttttgtcagtctttcttagtgcctgtgtggatttttgtgaaaatgtcaaagagaaaacttatatactatttcccttgaaattttaaactatattttctttacaggtatttataatataccaatgcttttatcaaacagaattttaaagagcataataaattatattaaagaaccaaaagttttcctgagaataagaaagtttcacccaataaaatatttttgaaaggcatgttcctctgtcaatgaaaaaaagtacatgtatgtgttgtgatattaaaagtgacatttgtctaatagcctaatacaacatgtagctgagtttaacatgtgtggtcttggtattcttaagggaacttccacattatacatttgatgtattgaccagaatatgtaaaatatgcttataaatcagaaaaataaattgtttctcactaagtcaaaagaaaaaaagctcatgtttccaccac

SEQ ID NO: 44 - DNA, 5166 bp, Artificial Sequence
  PCSK1
atttccattctggctgggaagggctggggctccactcagcctggagaccgaagcgcttcactgagcgctcgccgccgcccagcctctcctctcgcgcctcctagctcttcgcagagcaaccaggagccaggagtggtctagagcccgagggtgggaagggggagtctgtctggcttttctcctatcttgcttctttttcctcttcccttcccactcttgttcaagcgagtgtgtgagctatggagcgaagagcctggagtctgcagtgcactgctttcgtcctcttttgcgcttggtgtgcactgaacagtgcaaaagcgaaaaggcaatttgtcaatgaatgggcagcggagatccccgggggcccggaagcagcctcggccatcgccgaggagctgggctatgaccttttgggtcagattggttcacttgaaaatcactacttattcaaacataaaaaccaccccagaaggtctcgaaggagtgcctttcatatcactaagagattatctgatgatgatcgtgtgatatgggctgaacaacagtatgaaaaagaaagaagtaaacgttcagctctaagggactcagcactaaatctcttcaatgatcccatgtggaatcagcaatggtacttgcaagataccaggatgacggcagccctgcccaagctggaccttcatgtgatacctgtttggcaaaaaggcattacgggcaaaggagttgttatcaccgtactggatgatggtttggagtggaatcacacggacatttatgccaactatgatccagaggctagctatgattttaatgataatgaccatgatccatttccccgatatgatcccacaaacgagaacaaacacgggaccagatgtgcaggagaaattgccatgcaagcaaataatcacaaatgcggggttggagttgcatacaattccaaagttggaggcataagaatgctggatggcattgtgacggatgctattgaggccagttcaattggattcaatcctggacacgtggatatttacagtgcaagctggggccctaatgatgatgggaaaactgtggaggggcctggccggctagcccagaaggcttttgaatatggtgtcaaacaggggagacaggggaaggggtccatcttcgtctgggcttcgggaaacggggggcgtcagggagataattgtgactgtgatggctacacagacagcatctacaccatctccatcagcagtgcctcccagcaaggcctatccccctggtacgctgagaagtgctcctccacactggccacctcttacagcagcggagattacaccgaccagagaatcacgagcgctgacctgcacaatgactgcacggagacgcacacaggcacctcggcctctgcacctctggctgctggcatcttcgctctggccctggaagcaaacccaaatctcacctggcgagatatgcagcacctggttgtctggacctctgagtatgacccgctggccaataaccctggatggaaaaagaatggagcaggcttgatggtgaatagtcgatttggatttggcttgctaaatgccaaagctctggtggatttagctgaccccaggacctggaggagcgtgcctgagaagaaagagtgtgttgtaaaggacaatgactttgagcccagagccctgaaagctaatggagaagttatcattgaaattccaacaagagcttgtgaaggacaagaaaatgctatcaagtccctggagcatgtacaatttgaagcaacaattgaatattcccgaagaggagaccttcatgtcacacttacttctgctgctggaactagcactgtgctcttggctgaaagagaacgggatacatctcctaatggctttaagaattgggacttcatgtctgttcacacatggggagagaaccctataggtacttggactttgagaattacagacatgtctggaagaattcaaaatgaaggaagaattgtgaactggaagctgattttgcacgggacctcttctcagccagagcatatgaagcagcctcgtgtgtacacgtcctacaacactgttcagaatgacagaagaggggtggagaagatggtggatccaggggaggagcagcccacacaagagaaccctaaggagaacaccctggtgtccaaaagccccagcagcagcagcgtagggggccggagggatgagttggaggagggagccccttcccaggccatgctgcgactcctgcaaagtgctttcagtaaaaactcaccgccaaagcaatcaccaaagaagtccccaagtgcaaagctcaacatcccttatgaaaacttctacgaagccctggaaaagctgaacaaaccttcccagcttaaagactctgaagacagtctgtataatgactatgttgatgttttttataacactaaaccttacaagcacagagacgaccggctgcttcaagctctggtggacattctgaatgaggaaaattaaaataagtgtgtggtcccaagttggaaatattcatgcttcttccttaccctgcgattttgcctgtgtctgaagtggttgttttgtcatgaattcttatgcttataatatcctttgtggcaccttttctttttctccctaaactgtacatgtgaaggggatgagctcaagcaggaagttcaacttccagaattgatcataggtatttcaaaacacatctttcctgtctgcacaagtgaagtgttttgttctttctggagtcacagttgacaaaaagctcttacactacattagaacactgcattagagcccatttcaattctcaaaagaaaaggcaaaacctgggatatcaattaatttgaaaacataatctgcaaagaatgagaaggagtcagaaactgtttctgtagcttgttccctgtcttgtccatgtggttcttcaaattttgatgccaagaaagtatttggtaggcctaatgaaggagttcactgtaagactcattccctagatctttctattccaaagtgccactcattcctgtagtcaaaatctggtcatgttggtcaaaagctggattatttagatctagaaacagatcttgaaatctgaatgctctggtttgagcaattttcgaacattctttgcctggtgcactgtgtctgtggtgccagaggcgtccgtggatccagaggtggttatgactcgtgctgcatgcctggtctttcctctgtttctccttctgaaagttttctatacctgtctcctttctcagccacaaaataaatgttgggagaaatgatatataccactttcccagaaaaaaaaaaacttacacttgggacttggcaaattcctagtcacaatttttttcagcagtaacaggaaaccacttatcacatggagacctaatgtaataatagaaaaatactcataatagggagaaaccaagagaagttttgtttttgtttttttccaactgtgttcattagaacagcgtgttctaagtatttgaaactgaatgtttattccttgatactaaaagttcttctccaatcctatcactgatagtgtccaaattctcaccaaattgctcctaagcttcaaatcagaagcagaaactggcaggccatggaccttaattgtccctcaggtagattttgtttggtatgcagaatgtttttaaaatatgagtggttattgaaaatatgatgtttcacataaaacctcattctcggacccatctttgctcatggcaacagttagctggagctgagtagcagctgcctgattagatgactctcagtccccatggcaccctgctccatgttacctagagcaggcacttgattccttgctgggcagtatccaataggcatttgattttgcccactcctacactaagcgaatgtgtacaaagtgtaaatgcattaggaaaaacaaactacccgcatcttctgttaggcaggatctgtacaataataattatgagtttgcttatgtaatctcacctcacctggatgatcactaatactaattcatttattactaaccttctggcttccttctctcaatatgcttacaaagtctccagtcacctacaatgctggctttctcccactgagtttgctgtttgcaatttttccatgaagtttgaacttcataaggtaattcatggcattgaactggttcatgaaaagaacactagagtctgtcatttgctttggcttgaagtatggttggtaacacaaattttcacctgctcttctaccatttgaatttgtgtagagggtgtttgcagagcaatgcccgtaatgcttagagaatgttctcctaaaagacttgcggaatcactctgtccttggaagtttcatatattgtttgatatgaagtgttagatagaatttccaatattggagcatatcaaaaagtattaaaactaaaaaggaccagagaattcttagattggcccggaaaggccaataaagagttagaatgaaaactcattacttttccattcccaatctagtgctagatgtataaatctttcttttgattcttcctaacaaaatattttctgggttaaaaccccagccaactcattgggttgtagccaaaggttcactctcaagaagctttaatatttaaataaaatcatattgaatgtttccaacctggagtataatattcagatataaaacagttttgtcagtctttcttagtgcctgtgtggatttttgtgaaaatgtcaaagagaaaacttatatactatttcccttgaaattttaaactatattttctttacaggtatttataatataccaatgcttttatcaaacagaattttaaagagcataataaattatattaaagaaccaaaagttttcctgagaataagaaagtttcacccaataaaatatttttgaaaggcatgttcctctgtcaatgaaaaaaagtacatgtatgtgttgtgatattaaaagtgacatttgtctaatagcctaatacaacatgtagctgagtttaacatgtgtggtcttggtattcttaagggaacttccacattatacatttgatgtattgaccagaatatgtaaaatatgcttataaatcagaaaaataaattgtttctcactaagtcaaaagaaaaaaagctcatgtttccaccac

SEQ ID NO: 45 - DNA, 4824 bp, Artificial Sequence
  PCSK1
ggccagtcccactgcagggtcgagatgccgaactgactatggggaagggatctatttctttcttgttcttcagccaaattggttcacttgaaaatcactacttattcaaacataaaaaccaccccagaaggtctcgaaggagtgcctttcatatcactaagagattatctgatgatgatcgtgtgatatgggctgaacaacagtatgaaaaagaaagaagtaaacgttcagctctaagggactcagcactaaatctcttcaatgatcccatgtggaatcagcaatggtacttgcaagataccaggatgacggcagccctgcccaagctggaccttcatgtgatacctgtttggcaaaaaggcattacgggcaaaggagttgttatcaccgtactggatgatggtttggagtggaatcacacggacatttatgccaactatgatccagaggctagctatgattttaatgataatgaccatgatccatttccccgatatgatcccacaaacgagaacaaacacgggaccagatgtgcaggagaaattgccatgcaagcaaataatcacaaatgcggggttggagttgcatacaattccaaagttggaggcataagaatgctggatggcattgtgacggatgctattgaggccagttcaattggattcaatcctggacacgtggatatttacagtgcaagctggggccctaatgatgatgggaaaactgtggaggggcctggccggctagcccagaaggcttttgaatatggtgtcaaacaggggagacaggggaaggggtccatcttcgtctgggcttcgggaaacggggggcgtcagggagataattgtgactgtgatggctacacagacagcatctacaccatctccatcagcagtgcctcccagcaaggcctatccccctggtacgctgagaagtgctcctccacactggccacctcttacagcagcggagattacaccgaccagagaatcacgagcgctgacctgcacaatgactgcacggagacgcacacaggcacctcggcctctgcacctctggctgctggcatcttcgctctggccctggaagcaaacccaaatctcacctggcgagatatgcagcacctggttgtctggacctctgagtatgacccgctggccaataaccctggatggaaaaagaatggagcaggcttgatggtgaatagtcgatttggatttggcttgctaaatgccaaagctctggtggatttagctgaccccaggacctggaggagcgtgcctgagaagaaagagtgtgttgtaaaggacaatgactttgagcccagagccctgaaagctaatggagaagttatcattgaaattccaacaagagcttgtgaaggacaagaaaatgctatcaagtccctggagcatgtacaatttgaagcaacaattgaatattcccgaagaggagaccttcatgtcacacttacttctgctgctggaactagcactgtgctcttggctgaaagagaacgggatacatctcctaatggctttaagaattgggacttcatgtctgttcacacatggggagagaaccctataggtacttggactttgagaattacagacatgtctggaagaattcaaaatgaaggaagaattgtgaactggaagctgattttgcacgggacctcttctcagccagagcatatgaagcagcctcgtgtgtacacgtcctacaacactgttcagaatgacagaagaggggtggagaagatggtggatccaggggaggagcagcccacacaagagaaccctaaggagaacaccctggtgtccaaaagccccagcagcagcagcgtagggggccggagggatgagttggaggagggagccccttcccaggccatgctgcgactcctgcaaagtgctttcagtaaaaactcaccgccaaagcaatcaccaaagaagtccccaagtgcaaagctcaacatcccttatgaaaacttctacgaagccctggaaaagctgaacaaaccttcccagcttaaagactctgaagacagtctgtataatgactatgttgatgttttttataacactaaaccttacaagcacagagacgaccggctgcttcaagctctggtggacattctgaatgaggaaaattaaaataagtgtgtggtcccaagttggaaatattcatgcttcttccttaccctgcgattttgcctgtgtctgaagtggttgttttgtcatgaattcttatgcttataatatcctttgtggcaccttttctttttctccctaaactgtacatgtgaaggggatgagctcaagcaggaagttcaacttccagaattgatcataggtatttcaaaacacatctttcctgtctgcacaagtgaagtgttttgttctttctggagtcacagttgacaaaaagctcttacactacattagaacactgcattagagcccatttcaattctcaaaagaaaaggcaaaacctgggatatcaattaatttgaaaacataatctgcaaagaatgagaaggagtcagaaactgtttctgtagcttgttccctgtcttgtccatgtggttcttcaaattttgatgccaagaaagtatttggtaggcctaatgaaggagttcactgtaagactcattccctagatctttctattccaaagtgccactcattcctgtagtcaaaatctggtcatgttggtcaaaagctggattatttagatctagaaacagatcttgaaatctgaatgctctggtttgagcaattttcgaacattctttgcctggtgcactgtgtctgtggtgccagaggcgtccgtggatccagaggtggttatgactcgtgctgcatgcctggtctttcctctgtttctccttctgaaagttttctatacctgtctcctttctcagccacaaaataaatgttgggagaaatgatatataccactttcccagaaaaaaaaaaacttacacttgggacttggcaaattcctagtcacaatttttttcagcagtaacaggaaaccacttatcacatggagacctaatgtaataatagaaaaatactcataatagggagaaaccaagagaagttttgtttttgtttttttccaactgtgttcattagaacagcgtgttctaagtatttgaaactgaatgtttattccttgatactaaaagttcttctccaatcctatcactgatagtgtccaaattctcaccaaattgctcctaagcttcaaatcagaagcagaaactggcaggccatggaccttaattgtccctcaggtagattttgtttggtatgcagaatgtttttaaaatatgagtggttattgaaaatatgatgtttcacataaaacctcattctcggacccatctttgctcatggcaacagttagctggagctgagtagcagctgcctgattagatgactctcagtccccatggcaccctgctccatgttacctagagcaggcacttgattccttgctgggcagtatccaataggcatttgattttgcccactcctacactaagcgaatgtgtacaaagtgtaaatgcattaggaaaaacaaactacccgcatcttctgttaggcaggatctgtacaataataattatgagtttgcttatgtaatctcacctcacctggatgatcactaatactaattcatttattactaaccttctggcttccttctctcaatatgcttacaaagtctccagtcacctacaatgctggctttctcccactgagtttgctgtttgcaatttttccatgaagtttgaacttcataaggtaattcatggcattgaactggttcatgaaaagaacactagagtctgtcatttgctttggcttgaagtatggttggtaacacaaattttcacctgctcttctaccatttgaatttgtgtagagggtgtttgcagagcaatgcccgtaatgcttagagaatgttctcctaaaagacttgcggaatcactctgtccttggaagtttcatatattgtttgatatgaagtgttagatagaatttccaatattggagcatatcaaaaagtattaaaactaaaaaggaccagagaattcttagattggcccggaaaggccaataaagagttagaatgaaaactcattacttttccattcccaatctagtgctagatgtataaatctttcttttgattcttcctaacaaaatattttctgggttaaaaccccagccaactcattgggttgtagccaaaggttcactctcaagaagctttaatatttaaataaaatcatattgaatgtttccaacctggagtataatattcagatataaaacagttttgtcagtctttcttagtgcctgtgtggatttttgtgaaaatgtcaaagagaaaacttatatactatttcccttgaaattttaaactatattttctttacaggtatttataatataccaatgcttttatcaaacagaattttaaagagcataataaattatattaaagaaccaaaagttttcctgagaataagaaagtttcacccaataaaatatttttgaaaggcatgttcctctgtcaatgaaaaaaagtacatgtatgtgttgtgatattaaaagtgacatttgtctaatagcctaatacaacatgtagctgagtttaacatgtgtggtcttggtattcttaagggaacttccacattatacatttgatgtattgaccagaatatgtaaaatatgcttataaatcagaaaaataaattgtttctcactaagtcaaaagaaaaaaagctcatgtttccaccac

SEQ ID NO: 46 - DNA, 2516 bp, Artificial Sequence
  PCSK1
tctagctggtgtgtctctgatcttgcttcttttctcccagcccttcctacttgtgtgagaacaaggttttgagccatggagcaaagaggttggactctgcagtgtactgctttcgccttcttttgcgtttggtgtgcactaaacagtgtaaaagcaaagaggcagtttgttaatgaatgggcggcggagatccccggagggcaagaagctgcctctgccatcgccgaagaactggggtatgaccttttgggtcagattggatcacttgaaaatcactatttattcaaacacaaaagccatcctcggaggtcccgaagaagcgctcttcatatcactaagaggttatctgatgatgatcgtgtgacgtgggctgaacaacagtatgaaaaagagagaagtaaacgttcagttcaaaaagactcagcattggatctcttcaatgatccaatgtggaatcagcagtggtacttgcaagataccagaatgactgcagctctgcccaagctggaccttcatgtaatacctgtttgggaaaagggtattactggcaaaggagttgttattactgtactggatgatggcttggagtggaatcacacagacatttatgccaattatgatccagaggctagctatgattttaacgataatgatcatgatccatttccccgatatgatctcacaaatgaaaacaaacatggaacaagatgtgcaggtgaaattgccatgcaagcaaataatcacaagtgtggggttggagttgcatataattccaaagttggaggcataagaatgctggatggcattgtaactgatgccattgaggctagttcaattggattcaaccctggccatgtggatatttacagtgcaagctggggccctaatgatgatggaaaaactgtggaggggcctggcagactagcccagaaggcatttgaatatggtgtcaaacaggggagacaagggaaaggctccatctttgtctgggcttcagggaatgggggtcgtcagggagataactgtgactgtgatggctacacagacagcatttacaccatctctatcagcagtgcctcccagcaaggcctgtcaccttggtatgcagagaagtgttcttccacattggctacctcctacagcagtggtgattacacagaccagcgaataacaagcgctgacctgcacaatgactgcacagagacccacacaggcacctcggcttcagcacccctggctgctggtatctttgctctggccttggaggcaaacccaaatcttacctggagagatatgcagcatctggttgtctggacctctgagtacgacccattggccagtaacccaggttggaaaaagaatggggcaggcttgatggtgaacagccgatttggatttggcttgctaaatgccaaagctctggtggatttggctgatcctaggacctggagaaatgtgcctgagaagaaagaatgtgttgtaaaagacaataactttgagcctagagccctgaaagctaatggagaagtaattgttgaaatcccaacaagagcttgtgaaggacaagaaaatgctatcaagtctctggaacatgtgcaatttgaagcaacaattgaatattctcgtagaggagaccttcatgtcacactcacttctgctgttggaaccagcactgtactgttggctgaaagggaaagagatacatcccccaatggctttaagaattgggacttcatgtctgttcatacatggggagagaatcctgtaggcacctggacattgaaaattacagacatgtctggaagaatgcaaaatgaaggaaggattgtgaactggaagttgattttgcatgggacatcttctcaaccagagcacatgaagcagcctcgtgtgtacacatcctacaatacagtccagaatgacaggagaggagtggaaaagatggtgaatgttgtggagaagcggcccacacaaaagagcctgaatggcaatctcctggtacccaaaaactccagcagcagcaatgtggagggtagaagggatgagcaggtacaaggaactccttcaaaggccatgctgcgactcctacaaagtgcttttagcaagaatgcactttcaaaacaatcaccaaagaagtctccaagtgcaaagctcagcatcccttatgaaagtttctatgaagccttggaaaagctcaacaagccctccaagcttgaaggctctgaagacagtctgtacagtgactatgttgatgtattctataacacaaaaccttataagcatagagatgacaggctgctgcaagctctcatggacatcctaaatgaggagaattaaaataagtgtgttgcctgagttgggaatcttcatgcaccctccttttccttaaatgttcctgggtctggagttgttgtgtccctggtttttatgcttataatgtccttcattgtaattttactttttctttcaaactgtactttggagtgagtttcaaaatgaaagccaacttcatcatt

SEQ ID NO: 47 - protein, 753 aa, Artificial Sequence
  PCSK1
MERRAWSLQCTAFVLFCAWCALNSAKAKRQFVNEWAAEIPGGPEAASAIAEELGYDLLGQIGSLENHYLFKHKNHPRRSRRSAFHITKRLSDDDRVIWAEQQYEKERSKRSALRDSALNLFNDPMWNQQWYLQDTRMTAALPKLDLHVIPVWQKGITGKGVVITVLDDGLEWNHTDIYANYDPEASYDFNDNDHDPFPRYDPTNENKHGTRCAGEIAMQANNHKCGVGVAYNSKVGGIRMLDGIVTDAIEASSIGFNPGHVDIYSASWGPNDDGKTVEGPGRLAQKAFEYGVKQGRQGKGSIFVWASGNGGRQGDNCDCDGYTDSIYTISISSASQQGLSPWYAEKCSSTLATSYSSGDYTDQRITSADLHNDCTETHTGTSASAPLAAGIFALALEANPNLTWRDMQHLVVWTSEYDPLANNPGWKKNGAGLMVNSRFGFGLLNAKALVDLADPRTWRSVPEKKECVVKDNDFEPRALKANGEVIIEIPTRACEGQENAIKSLEHVQFEATIEYSRRGDLHVTLTSAAGTSTVLLAERERDTSPNGFKNWDFMSVHTWGENPIGTWTLRITDMSGRIQNEGRIVNWKLILHGTSSQPEHMKQPRVYTSYNTVQNDRRGVEKMVDPGEEQPTQENPKENTLVSKSPSSSSVGGRRDELEEGAPSQAMLRLLQSAFSKNSPPKQSPKKSPSAKLNIPYENFYEALEKLNKPSQLKDSEDSLYNDYVDVFYNTKPYKHRDDRLLQALVDILNEEN

SEQ ID NO: 48 - protein, 706 aa, Artificial Sequence
  PCSK1
MGKGSISFLFFSQIGSLENHYLFKHKNHPRRSRRSAFHITKRLSDDDRVIWAEQQYEKERSKRSALRDSALNLFNDPMWNQQWYLQDTRMTAALPKLDLHVIPVWQKGITGKGVVITVLDDGLEWNHTDIYANYDPEASYDFNDNDHDPFPRYDPTNENKHGTRCAGEIAMQANNHKCGVGVAYNSKVGGIRMLDGIVTDAIEASSIGFNPGHVDIYSASWGPNDDGKTVEGPGRLAQKAFEYGVKQGRQGKGSIFVWASGNGGRQGDNCDCDGYTDSIYTISISSASQQGLSPWYAEKCSSTLATSYSSGDYTDQRITSADLHNDCTETHTGTSASAPLAAGIFALALEANPNLTWRDMQHLVVWTSEYDPLANNPGWKKNGAGLMVNSRFGFGLLNAKALVDLADPRTWRSVPEKKECVVKDNDFEPRALKANGEVIIEIPTRACEGQENAIKSLEHVQFEATIEYSRRGDLHVTLTSAAGTSTVLLAERERDTSPNGFKNWDFMSVHTWGENPIGTWTLRITDMSGRIQNEGRIVNWKLILHGTSSQPEHMKQPRVYTSYNTVQNDRRGVEKMVDPGEEQPTQENPKENTLVSKSPSSSSVGGRRDELEEGAPSQAMLRLLQSAFSKNSPPKQSPKKSPSAKLNIPYENFYEALEKLNKPSQLKDSEDSLYNDYVDVFYNTKPYKHRDDRLLQALVDILNEEN

SEQ ID NO: 49 - protein, 753 aa, Artificial Sequence
  PCSK1
MEQRGWTLQCTAFAFFCVWCALNSVKAKRQFVNEWAAEIPGGQEAASAIAEELGYDLLGQIGSLENHYLFKHKSHPRRSRRSALHITKRLSDDDRVTWAEQQYEKERSKRSVQKDSALDLFNDPMWNQQWYLQDTRMTAALPKLDLHVIPVWEKGITGKGVVITVLDDGLEWNHTDIYANYDPEASYDFNDNDHDPFPRYDLTNENKHGTRCAGEIAMQANNHKCGVGVAYNSKVGGIRMLDGIVTDAIEASSIGFNPGHVDIYSASWGPNDDGKTVEGPGRLAQKAFEYGVKQGRQGKGSIFVWASGNGGRQGDNCDCDGYTDSIYTISISSASQQGLSPWYAEKCSSTLATSYSSGDYTDQRITSADLHNDCTETHTGTSASAPLAAGIFALALEANPNLTWRDMQHLVVWTSEYDPLASNPGWKKNGAGLMVNSRFGFGLLNAKALVDLADPRTWRNVPEKKECVVKDNNFEPRALKANGEVIVEIPTRACEGQENAIKSLEHVQFEATIEYSRRGDLHVTLTSAVGTSTVLLAERERDTSPNGFKNWDFMSVHTWGENPVGTWTLKITDMSGRMQNEGRIVNWKLILHGTSSQPEHMKQPRVYTSYNTVQNDRRGVEKMVNVVEKRPTQKSLNGNLLVPKNSSSSNVEGRRDEQVQGTPSKAMLRLLQSAFSKNALSKQSPKKSPSAKLSIPYESFYEALEKLNKPSKLEGSEDSLYSDYVDVFYNTKPYKHRDDRLLQALMDILNEEN

SEQ ID NO: 50 - DNA, 3710 bp, Artificial Sequence
  PDK4
aggacgcgtttccaagttccagtgactcctcctgtttgggactcggggggagagtgcggggagacaaataaaacctcgggcggcggcggctggtgggaagacttgaacttgaatctcgaaccactgcatctccgactctgcccagactcttcactccgcggcaccctcaaaccccagcccaggccggggcgcacaagccagccagcgcacctgcagtcctcgcccggacgcgccgcgccccctcggaaccaggctctgctccgagcagccttcgcccctcaagccagccacagtccccgccaggccgggtgggcgtcaagatgaaggcggcccgcttcgtgctgcgcagcgctggctcgctcaacggcgccggcctggtgccccgagaggtggagcatttctcgcgctacagcccgtccccgctgtccatgaagcagctactggactttggttcagaaaatgcatgtgaaagaacttcttttgcatttttgcgacaagaattgcctgtgagactcgccaacattctgaaggaaattgatatcctcccgacccaattagtaaatacctcttcagtgcaattggttaaaagctggtatatacagagcctgatggatttggtggaattccatgagaaaagcccagatgaccagaaagcattatcagactttgtagatacactcatcaaagttcgaaatagacaccataatgtagtccctacaatggcacaaggaatcatagagtataaagatgcctgtacagttgacccagtcaccaatcaaaatcttcaatatttcttggatcgattttacatgaaccgtatttctactcggatgctgatgaaccagcacattcttatatttagtgactcacagacaggaaacccaagccacattggaagcattgatcctaactgtgatgtggtagcagtggtccaagatgcctttgagtgttcaaggatgctctgtgatcagtattatttatcatctccagaattaaagcttacacaagtgaatggaaaatttccagaccaaccaattcacatcgtgtatgttccttctcacctccatcatatgctctttgaactatttaagaatgcaatgcgggcaacagttgaacaccaggaaaatcagccttcccttacaccaatagaggttattgttgtcttgggaaaagaagaccttaccattaagatttcagacagaggaggtggtgttcccctgagaattattgaccgcctctttagttatacatactccactgcaccaacgcctgtgatggataattcccggaatgctcctttggctggttttggttacggcttgccaatttctcgtctgtatgcaaagtactttcaaggagatctgaatctctactctttatcaggatatggaacagatgctatcatctacttaaaggctttgtcttctgagtctatagaaaaacttccagtttttaacaagtcagccttcaaacattatcagatgagctctgaggctgatgactggtgtatcccaagcagggaaccaaagaacctggcaaaagaagtggccatgtgaagagggacactcaggacactttacgggatcaaagtgggtctacaccagtgctgcttcctgaatgtttgtgtgtgaacccttgtttcctccaaaacaaacgacagcaacgaaaactccttaatcagaacactgatccaatgaggaatggagcttgtttctgtgacccaggagaacttagtgcaagactacaggagttaacagatggccagctccttattttttaatgtagaataactcctgagtttatatcaaatcctgaagaaataagcctcagttttccatctgtttttgataagaataagaaagggagtgagtgtgaagatggtggttagcagtttcactaagactgatattttaggcctcttgttcacatcaaaagatattggtgtcagaataccagcattttcctgccatgcaaaggattaaaacttagtttacactatgtggttacaaatatatgtcaatgtacattttgaacatatttatgtgctatggaaggaaatgctggtgactaaaataaggtttactctgaaagaggaggaattttattcaaagcattcaaacattttattcaagtgtttcaaaattcaaagcattgtattcaaagttgcagtgaaggcatcaacttatgtaaaaactcagaaggaaggctcctctgataaaaacacagctcctttattatgctgcttttcttgttcactttacacactaagtaaacacttattgtcaggtgcctagtcttgagtgaattgttagatgtgcactgaactcgggatgttggggattggagagagagaattgccaaagtaacagcaaaaatatctcttactttgctttgtttataaataaattagtagattggaaaaactagtgttagggaaagaaatcacatgttcagagcctaattcagtaggaagggcttttctctaccctgaaatgaaggtaatccaaaggcatccattttctaggcttaaaagatatatttttgatatatttaattatattctctacactccagcattaatatgtctgtttaaaaattactaattctcaaatggctcaagaacattagaatttaagtaccttttagagtaattattttaagcaaatagcctggacgtaagagattctcatgccagcatgctttcatttgtcagttgttgtgactgagagataatgaatgacacctgaaatgcatatggtatttttgggagagttaaggtataatttgaaggttggcagaccagttgcgctgattactcttagagaagaagaaatggaaaaatgaaagaaggcaggaaggaaagaaaggatataggaagagagggaagcagaaggcaggcatttttctattttccccacaaattatttcaaaaaaaatctgtattttctgggatatgtcattggcaagaggaagaactggtgttttgaaagcagtatggattctttaaatgcctctcactcttacaagatagtaggctttgagataataaacttacccgtgtcaattaacatttaaactggcatatagaaaaaaaggaggatttttctgcattgtaaaataatcagtatggtttatatgttgaatttgacatttgtgtgtaatttcatggtggcctagtgttgtggtgcttctggtaatggtaatagaagctcaactatttttttgtggatttcagtttttatcatcagaagtcctagacagtgacatttcttaatggtgggagtccagctcatgcatttctgattatacaaaacagtttgcagtaggttatttgtcatttcagttttttactgaaatttgagctaaacatttttacatgtaaatacttgtatttaccaaagatttaaatcagttgattaattaattaactcaaatactgtgaactatctctaaaacactagaaaaaagaaatgttagtatctcaattacaccaactgtgcaaatgaactttgataaaatagaaataatctacattggcctttgtgaaatctggggaagagctttaggattctagtagatggatactgaatactcaggcccacttaaattattaatgtatacattgtgtttttgtctttatgctatgtacagagaaatgtgataattttttataataaatattttttatgatgataaaagaaaaaaaaaaa

SEQ ID NO: 51 - protein, 411 aa, Artificial Sequence
  PDK4
MKAARFVLRSAGSLNGAGLVPREVEHFSRYSPSPLSMKQLLDFGSENACERTSFAFLRQELPVRLANILKEIDILPTQLVNTSSVQLVKSWYIQSLMDLVEFHEKSPDDQKALSDFVDTLIKVRNRHHNVVPTMAQGIIEYKDACTVDPVTNQNLQYFLDRFYMNRISTRMLMNQHILIFSDSQTGNPSHIGSIDPNCDVVAVVQDAFECSRMLCDQYYLSSPELKLTQVNGKFPDQPIHIVYVPSHLHHMLFELFKNAMRATVEHQENQPSLTPIEVIVVLGKEDLTIKISDRGGGVPLRIIDRLFSYTYSTAPTPVMDNSRNAPLAGFGYGLPISRLYAKYFQGDLNLYSLSGYGTDAIIYLKALSSESIEKLPVFNKSAFKHYQMSSEADDWCIPSREPKNLAKEVAM

SEQ ID NO: 52 - DNA, 3480 bp, Artificial Sequence
  RGS4
tactccctcctttggtcctcgagctgccggtttagactttttacaggacgcaggcatgtgaaggagaaactgtcagtgctaggctgaattctgttgttaccaagatttctagaaaagtattcctcagtcaggttgattacagatatagcaaatctatttttcctagggtagtttctgtatgctgccgggcttataactgtctgtcatccagctatttctctccaccttcttgtttgcataacaaccaaggcaacttccgcaaatcactgcgtggagacgatgatcctgccagctcccttttggaaatcgtgaggatcagatcttggaccatgtataatatgatgcttctaatccaaaagaggaaaggcattgggagtcagctcctaagggctggagaggcagagggagacagaggagctggtactgcagagcggtcgtctgattggctggacggtcgtagctgggctataaaagagacccctacaggcttagcaggaagacgctcagaggattctgacaatatctttaccggagaagaggcaaagtacgctcaaagccgaagccacagctcctcctgccgcatttctttcctgcttgcgaattccaagctgttaaataagatgtgcaaagggcttgcaggtctgccggcttcttgcttgaggagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtgggaccccattccagtccaattttcctaagtttctttgagggttccatgggagcaaatatctaaataatggcctggtaggtctggattttcaaagattgttggcagtttcctcctcccaacagttttacctcgggatggttggttagtgcatgtcacatgacatccacatgcacatgtattctgttggccagcacgttctccagactctagatgtttagatgaggttgagctatgatatgtgcttgtgtgtatgtctatgtgtatatattatatatacattagacacacatatacattatttctgtatatagatgtctgtgtatacatatgtatgtgtgagtgtatgtatacacacacacacacacacacacacacacttttgcaagagtgatgggaaagaccctaggtgctcataactagagtatgtgtatgtacttacatgggtgttttgatctctgttctttcatactacatttgaacagggcaaaatgaactaactgccatgtaggctaagaaagaaatgctaacctgtggaaagttggttttgtaaaattccatggatcttgctggagaagcatccaaggaacttcatgcttgatttgaccactgacagcctccaccttgagcactattctaaggagcaaataccttagctcccttgagctggttttctctgatggcacttttgagctcctaagctgccagccttcccttcttttcctgggtgctcagggcatgcttattagcagctgggttggtatggagttggcagacaggatgttcaacttaatgaagaaatacagctaaggccttgccagcaacacctgccgtaagttactggctgagtgagggcatagaagttaaaggttactgtttttatcctctatccttttttcctttcctgatcaaggtgctcttctcattttttcctgagaaccttagccatcagatgaggctccttagtttattgtggttggttgttttttctttataatggctctgggctatatgcctatatttataaaccagcagcaggggaaagattatattttataagagggaacaaattttcacaatttgaaaagcccacataagttttctcttttaaggtagaatcttgttaatttcattccaaacatcggggctaacagagactggaggcatttctttttaggctctgagactaaatgagaggaaaagaaaagaaaaaaaaaatgattgtctaaccaattgtgagaattactgtttgaaacttttcaaggcacattgaaatacttgaaaacttctcatttatgttatttatgatgttattttgtacgtgttattattattatattgttttataaatggaggtacaggatatcacctgaattattaatgaatgcccaggaagtaattttcttctcattcttctaaaactactgcctttcaaagtgcacacacacgcgtccacatacactgcattcgttgctccagtataaattacatgcatgagcacctttctggcttttaagccaatataatgggctgcaaaatgaagacaccagagtgtatgcatacaaatctcactgtattaaagatgcaggttttctaattgtacccttcttgtctctctggcaatcttgcccttaatatccctggagttcctcatcagtgtcattttctgttatacacagttccacaattttgtctctagttgacttcaaatgtgtaactttattggtcttgccctattataattgtcatgactttcagattgtatctgaactcacagactgctgtcttactaataggtctggaaggtcacgctgaatgagaagtaaattattttatgtaatacatttttgagtgtgtttttcagttgtatttccctgttatttcatcactatttccaatggtgagcttgcctgctcatgctccctggacagaatactccttccttttgcatgcctgtttctatcatgtgcttgataggcctcaaagctaatgcttccagtgaaacacacgcatcttaataataagggtaaataaacgctccatatgaaacta

SEQ ID NO: 53 - DNA, 3055 bp, Artificial Sequence
  RGS4
actttcccgaggtgcttctacagttccctctgccagcaggggaacagatggaaatagcaatcacctgccagaaggtggcgtgcagcaaggatgtgcatcttttgccgctactgctttctgattcctaaaaattactcagagatcactcatgtgttcagtgattcaggttctgttgaagataccaaagatattcggttggtcaaaatgacgggcatataaaggcttctcaggtttctgagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtgggaccccattccagtccaattttcctaagtttctttgagggttccatgggagcaaatatctaaataatggcctggtaggtctggattttcaaagattgttggcagtttcctcctcccaacagttttacctcgggatggttggttagtgcatgtcacatgacatccacatgcacatgtattctgttggccagcacgttctccagactctagatgtttagatgaggttgagctatgatatgtgcttgtgtgtatgtctatgtgtatatattatatatacattagacacacatatacattatttctgtatatagatgtctgtgtatacatatgtatgtgtgagtgtatgtatacacacacacacacacacacacacacacttttgcaagagtgatgggaaagaccctaggtgctcataactagagtatgtgtatgtacttacatgggtgttttgatctctgttctttcatactacatttgaacagggcaaaatgaactaactgccatgtaggctaagaaagaaatgctaacctgtggaaagttggttttgtaaaattccatggatcttgctggagaagcatccaaggaacttcatgcttgatttgaccactgacagcctccaccttgagcactattctaaggagcaaataccttagctcccttgagctggttttctctgatggcacttttgagctcctaagctgccagccttcccttcttttcctgggtgctcagggcatgcttattagcagctgggttggtatggagttggcagacaggatgttcaacttaatgaagaaatacagctaaggccttgccagcaacacctgccgtaagttactggctgagtgagggcatagaagttaaaggttactgtttttatcctctatccttttttcctttcctgatcaaggtgctcttctcattttttcctgagaaccttagccatcagatgaggctccttagtttattgtggttggttgttttttctttataatggctctgggctatatgcctatatttataaaccagcagcaggggaaagattatattttataagagggaacaaattttcacaatttgaaaagcccacataagttttctcttttaaggtagaatcttgttaatttcattccaaacatcggggctaacagagactggaggcatttctttttaggctctgagactaaatgagaggaaaagaaaagaaaaaaaaaatgattgtctaaccaattgtgagaattactgtttgaaacttttcaaggcacattgaaatacttgaaaacttctcatttatgttatttatgatgttattttgtacgtgttattattattatattgttttataaatggaggtacaggatatcacctgaattattaatgaatgcccaggaagtaattttcttctcattcttctaaaactactgcctttcaaagtgcacacacacgcgtccacatacactgcattcgttgctccagtataaattacatgcatgagcacctttctggcttttaagccaatataatgggctgcaaaatgaagacaccagagtgtatgcatacaaatctcactgtattaaagatgcaggttttctaattgtacccttcttgtctctctggcaatcttgcccttaatatccctggagttcctcatcagtgtcattttctgttatacacagttccacaattttgtctctagttgacttcaaatgtgtaactttattggtcttgccctattataattgtcatgactttcagattgtatctgaactcacagactgctgtcttactaataggtctggaaggtcacgctgaatgagaagtaaattattttatgtaatacatttttgagtgtgtttttcagttgtatttccctgttatttcatcactatttccaatggtgagcttgcctgctcatgctccctggacagaatactccttccttttgcatgcctgtttctatcatgtgcttgataggcctcaaagctaatgcttccagtgaaacacacgcatcttaataataagggtaaataaacgctccatatgaaacta

SEQ ID NO: 54 - DNA, 2924 bp, Artificial Sequence
  RGS4
gctggagaggcagagggagacagaggagctggtactgcagagcggtcgtctgattggctggacggtcgtagctgggctataaaagagacccctacaggcttagcaggaagacgctcagaggattctgacaatatctttaccggagaagaggcaaagtacgctcaaagccgaagccacagctcctcctgccgcatttctttcctgcttgcgaattccaagctgttaaataagatgtgcaaagggcttgcaggtctgccggcttcttgcttgaggagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtgggaccccattccagtccaattttcctaagtttctttgagggttccatgggagcaaatatctaaataatggcctggtaggtctggattttcaaagattgttggcagtttcctcctcccaacagttttacctcgggatggttggttagtgcatgtcacatgacatccacatgcacatgtattctgttggccagcacgttctccagactctagatgtttagatgaggttgagctatgatatgtgcttgtgtgtatgtctatgtgtatatattatatatacattagacacacatatacattatttctgtatatagatgtctgtgtatacatatgtatgtgtgagtgtatgtatacacacacacacacacacacacacacacttttgcaagagtgatgggaaagaccctaggtgctcataactagagtatgtgtatgtacttacatgggtgttttgatctctgttctttcatactacatttgaacagggcaaaatgaactaactgccatgtaggctaagaaagaaatgctaacctgtggaaagttggttttgtaaaattccatggatcttgctggagaagcatccaaggaacttcatgcttgatttgaccactgacagcctccaccttgagcactattctaaggagcaaataccttagctcccttgagctggttttctctgatggcacttttgagctcctaagctgccagccttcccttcttttcctgggtgctcagggcatgcttattagcagctgggttggtatggagttggcagacaggatgttcaacttaatgaagaaatacagctaaggccttgccagcaacacctgccgtaagttactggctgagtgagggcatagaagttaaaggttactgtttttatcctctatccttttttcctttcctgatcaaggtgctcttctcattttttcctgagaaccttagccatcagatgaggctccttagtttattgtggttggttgttttttctttataatggctctgggctatatgcctatatttataaaccagcagcaggggaaagattatattttataagagggaacaaattttcacaatttgaaaagcccacataagttttctcttttaaggtagaatcttgttaatttcattccaaacatcggggctaacagagactggaggcatttctttttaggctctgagactaaatgagaggaaaagaaaagaaaaaaaaaatgattgtctaaccaattgtgagaattactgtttgaaacttttcaaggcacattgaaatacttgaaaacttctcatttatgttatttatgatgttattttgtacgtgttattattattatattgttttataaatggaggtacaggatatcacctgaattattaatgaatgcccaggaagtaattttcttctcattcttctaaaactactgcctttcaaagtgcacacacacgcgtccacatacactgcattcgttgctccagtataaattacatgcatgagcacctttctggcttttaagccaatataatgggctgcaaaatgaagacaccagagtgtatgcatacaaatctcactgtattaaagatgcaggttttctaattgtacccttcttgtctctctggcaatcttgcccttaatatccctggagttcctcatcagtgtcattttctgttatacacagttccacaattttgtctctagttgacttcaaatgtgtaactttattggtcttgccctattataattgtcatgactttcagattgtatctgaactcacagactgctgtcttactaataggtctggaaggtcacgctgaatgagaagtaaattattttatgtaatacatttttgagtgtgtttttcagttgtatttccctgttatttcatcactatttccaatggtgagcttgcctgctcatgctccctggacagaatactccttccttttgcatgcctgtttctatcatgtgcttgataggcctcaaagctaatgcttccagtgaaacacacgcatcttaataataagggtaaataaacgctccatatgaaacta

SEQ ID NO: 55 - DNA, 3371 bp, Artificial Sequence
  RGS4
attgggagtcagctcctaagtaagctccagaattcctgctggtacttttccttccaggaagcaacttccttgatattttttttttacaggcatatgaataaaaactatattttgcagcattgtacactttttttccttttctagaaattctaaacctctgacattggtggagacattgagtacattttttcccatatccctacttttcagaaggattttctctgctcgttcacttaacattgctgatgcgtcagtcttttcttcctcatctctttcaggggctggagaggcagagggagacagaggagctggtactgcagagcggtcgtctgattggctggacggtcgtagctgggctataaaagagacccctacaggcttagcaggaagacgctcagaggattctgacaatatctttaccggagaagaggcaaagtacgctcaaagccgaagccacagctcctcctgccgcatttctttcctgcttgcgaattccaagctgttaaataagatgtgcaaagggcttgcaggtctgccggcttcttgcttgaggagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtgggaccccattccagtccaattttcctaagtttctttgagggttccatgggagcaaatatctaaataatggcctggtaggtctggattttcaaagattgttggcagtttcctcctcccaacagttttacctcgggatggttggttagtgcatgtcacatgacatccacatgcacatgtattctgttggccagcacgttctccagactctagatgtttagatgaggttgagctatgatatgtgcttgtgtgtatgtctatgtgtatatattatatatacattagacacacatatacattatttctgtatatagatgtctgtgtatacatatgtatgtgtgagtgtatgtatacacacacacacacacacacacacacacttttgcaagagtgatgggaaagaccctaggtgctcataactagagtatgtgtatgtacttacatgggtgttttgatctctgttctttcatactacatttgaacagggcaaaatgaactaactgccatgtaggctaagaaagaaatgctaacctgtggaaagttggttttgtaaaattccatggatcttgctggagaagcatccaaggaacttcatgcttgatttgaccactgacagcctccaccttgagcactattctaaggagcaaataccttagctcccttgagctggttttctctgatggcacttttgagctcctaagctgccagccttcccttcttttcctgggtgctcagggcatgcttattagcagctgggttggtatggagttggcagacaggatgttcaacttaatgaagaaatacagctaaggccttgccagcaacacctgccgtaagttactggctgagtgagggcatagaagttaaaggttactgtttttatcctctatccttttttcctttcctgatcaaggtgctcttctcattttttcctgagaaccttagccatcagatgaggctccttagtttattgtggttggttgttttttctttataatggctctgggctatatgcctatatttataaaccagcagcaggggaaagattatattttataagagggaacaaattttcacaatttgaaaagcccacataagttttctcttttaaggtagaatcttgttaatttcattccaaacatcggggctaacagagactggaggcatttctttttaggctctgagactaaatgagaggaaaagaaaagaaaaaaaaaatgattgtctaaccaattgtgagaattactgtttgaaacttttcaaggcacattgaaatacttgaaaacttctcatttatgttatttatgatgttattttgtacgtgttattattattatattgttttataaatggaggtacaggatatcacctgaattattaatgaatgcccaggaagtaattttcttctcattcttctaaaactactgcctttcaaagtgcacacacacgcgtccacatacactgcattcgttgctccagtataaattacatgcatgagcacctttctggcttttaagccaatataatgggctgcaaaatgaagacaccagagtgtatgcatacaaatctcactgtattaaagatgcaggttttctaattgtacccttcttgtctctctggcaatcttgcccttaatatccctggagttcctcatcagtgtcattttctgttatacacagttccacaattttgtctctagttgacttcaaatgtgtaactttattggtcttgccctattataattgtcatgactttcagattgtatctgaactcacagactgctgtcttactaataggtctggaaggtcacgctgaatgagaagtaaattattttatgtaatacatttttgagtgtgtttttcagttgtatttccctgttatttcatcactatttccaatggtgagcttgcctgctcatgctccctggacagaatactccttccttttgcatgcctgtttctatcatgtgcttgataggcctcaaagctaatgcttccagtgaaacacacgcatcttaataataagggtaaataaacgctccatatgaaacta

SEQ ID NO: 56 - DNA, 2951 bp, Artificial Sequence
  RGS4
gaggctcagaggattctgacagcttctttgcagagcagaagcaactgtgctcaaaatagaaaccaccgcggctcccgctgcctttctctcctcgctaagaatccctcagttaaacaagatgtgcaaaggacttgcaggtctgccggcttcctgcctgaggagtgcaaaggacatgaaacatcggctggggttcctgctgcagaagtcagattcctgcgaacacagttcttcacacagcaagaaggacaaagtagtaacttgccagagggtaagccaagaagaagtcaagaaatgggctgaatcgttggaaaacctgattcaccatgaatgtggactggcagctttcaaagctttcctgaagtcggaatacagcgaggagaacattgacttctggatcagctgtgaggagtacaagaagatcaagtcaccttctaaactaagtcccaaagccaagaagatctacaacgagttcatctcagtgcaagcaacaaaagaggtgaacctggactcttgcaccagagaggagacaagccggaacatgttacagcccacaataacctgttttgatgaagcccagaagaagattttcaacctgatggaaaaggattcctaccgccgcttcctcaagtctcgattctatcttgacctgaccaatccttccagctgcggggcagagaagcagaaaggagccaagagttctgcagactgcacttccctggtctcccagtgtgcctaattctcacacagaggcagggagcccaaatgccaagactctatgctctgaaaaacctgaggccaaatattgatcttaagcaccaatgctttatccacattgtagcctagtgtccatgctgcctgccgcgtgtgagtcacttccatgtaaaactagccttagttgtggtgttggggttttcactagggtaagacccaatttgttttaaattttcccaagtctccttaagggtgagcaagtttccaaataatggctccgtaggtctggattttcaaagatggctggcagtctgcccctttcaacagtttgacctcaagttagttagttggtacacttcatgtgacattccatgcacatgtaatgttggccagcagcacttcctacggactctcaatgtttaggtgatatttgtgtatgcatatgtatacattaaaatatacataacatatgcatatacattctgtatatattatacctatgtattcaatgtgtgtgaatgtgcatgaatatgtatctatctatctatatatgtatatactgacacatgcacacacatttctttaagaaaagatgggaaagatcctaggtgctcaaactggagtgtgtagacatgcttgcatgcatgttctgatttctggtccttcataccgtgtctgaacagggcaaactgaattaactgccatgcaggctaagaaaggaacagtaacttgtggggaatgagttctatagaaccactgggtcttggcggagaatagccagggcctttgtgtttagttgttgatggcctccacattgagcactaagctaaggggtgagcactctgaaaactctgctgtctgactgacactgaactgccttgcatcagtgatcactactggcactttttaagtccctctgctgatggccttccctcctttgcctgggtgctcagggtgtgctgattagcagctgggttggtctagagctgaatgtttgagctgaatgaaggaatgtggtccaggctttgctgcctagccctaccaaggactactgcttaggtgagggcagaggacctaaagattatcttaattctttcctcttttgataaggtgctcttcttttccttcccctcaagaatgtcacctgtcagaggagcctccttagttccctgtggttggttgttcactttaaaaaccacggctacctgccgtggttctaagctacatgcctacatctgtaaagcatcatcggggggaaaggttatgttttatcaggaggaaggaagttctcatgaactgcaaagccctctttggttttctgctttgaggtaagagcttgttcaccccatcccaaacaccaaggctagcagagaccaatgaaaggagagaggaaaggaaaaagaaagagaaaagaaaacagaagaggagaggctatcagttggtaggactactgcttggagcttttcaaggcacgtgaaatacttgaaaatttctcatttgtgttatttatgatgttttgtacagtgtttttattattgtattgttttataaatggaggtacaggatattacccaaattattaatgaatgcccaagaagtaatttccttctcattcttctaaaagtactgcctttgagagcacacacacattcgtgcaacactgcagtcattgctccagtttaaattacatgtgtgagcaccattgtggctagtaagccaatgtaccgggctgcaaaatgaagacactggaatagtgtgtatccaagtctcgtcgtattgaagaaataattttctaagggtactcgtttcgtctctcttgacagtcttgcttgtaatgtccccagagctcccccatcagtgttcctaactcctttttgttatacaccccatccatgatcatgtctgtataactctttggtcttgccctaatagtatcatgactttgagattgtacctgtactcacagactgctgtttcacaaataggtctggaaagtcattctgaatgagaagtaaattattttgtgtaatacatcctgagtgtgttttcaattgtatttccatcgctccttggaatggtgagcctgcctgccgctggtccatgtaaggaatgctcctcccatatgcatgtctgcttctgccatgtgctttataggcctcaacactgatgcttccgacgaaacacacaaatcttaatgatgacagtaaataaatgcttcctacaaaacaaaaaaaaaaaaa

SEQ ID NO: 57 - protein, 302 aa, Artificial Sequence
  RGS4
MYNMMLLIQKRKGIGSQLLRAGEAEGDRGAGTAERSSDWLDGRSWAIKETPTGLAGRRSEDSDNIFTGEEAKYAQSRSHSSSCRISFLLANSKLLNKMCKGLAGLPASCLRSAKDMKHRLGFLLQKSDSCEHNSSHNKKDKVVICQRVSQEEVKKWAESLENLISHECGLAAFKAFLKSEYSEENIDFWISCEEYKKIKSPSKLSPKAKKIYNEFISVQATKEVNLDSCTREETSRNMLEPTITCFDEAQKKIFNLMEKDSYRRFLKSRFYLDLVNPSSCGAEKQKGAKSSADCASLVPQCA

SEQ ID NO: 58 - protein, 187 aa, Artificial Sequence
  RGS4
MKHRLGFLLQKSDSCEHNSSHNKKDKVVICQRVSQEEVKKWAESLENLISHECGLAAFKAFLKSEYSEENIDFWISCEEYKKIKSPSKLSPKAKKIYNEFISVQATKEVNLDSCTREETSRNMLEPTITCFDEAQKKIFNLMEKDSYRRFLKSRFYLDLVNPSSCGAEKQKGAKSSADCASLVPQCA

SEQ ID NO: 59 - protein, 754 aa, Artificial Sequence
  RGS4
MSLDVEYARRRRNTHDTFDFHREFDHRVDATHRRGSLCDRHCGINIPTDLVDTHSGSHQHSLLTPRLLPGASSTPVFCPHGSEEVQPCNVCMIKTTITAENEVEALKLSNNYKFGFKKWKGHVTERPWEDRSEIVKELYSELNTVKTHSESLITFGNLLYVILFGWWITLFYLLVSALMFFSIIGAPYGGLCWRLAGYFIWPFGKVILKSGTGHTRKCCVRFTKCEAIPEVDEMEKTPLIDKCERLHTDFQHSDMGYWCRISTYVWLVLGFPVLAVTHGLACFVSWILVFFIPISRMNARTLSKLLLVPPEQVQIRSSNKMEGSFETSITLCCYHAVNIYYYKYTVDGLNVFAVNLILLVIVSLTLGYADHHNHYTSSLVKFTLSLVSIMPLSYYIGMAIASVSAQSNFAVGAVVNATFGSIIELTFYITALIKGAREGNRCYEEVVKSALTGTVLGCVLFVPGLCMIIGGIKHREQRFNSRSAGVGSALLFISVGGVFAPTLFSKVYGKMICGECMDISQNETERYICSNCQTDVMEVNSTAFYSEVKPLVYTVSILLPAAYIIGLLFTLKTHSHIYDIHISDCHVPGHHHSAVVHWSRWRAMIILLGSTLLMSACADLATEHISPILKEATVSQYFIGVTILALIPELPEIVNGIQFALLNNLSLSIEIGSCIAVQVCMLQIPILVLFSVFYATDFTLIFSDLHLWASIFSVILMNYIFMDGKCDYFQGTVLVFVYFILLAMYFFAPSPVGC

SEQ ID NO: 60 - protein, 205 aa, Artificial Sequence
  RGS4
MCKGLAGLPASCLRSAKDMKHRLGFLLQKSDSCEHNSSHNKKDKVVICQRVSQEEVKKWAESLENLISHECGLAAFKAFLKSEYSEENIDFWISCEEYKKIKSPSKLSPKAKKIYNEFISVQATKEVNLDSCTREETSRNMLEPTITCFDEAQKKIFNLMEKDSYRRFLKSRFYLDLVNPSSCGAEKQKGAKSSADCASLVPQCA

SEQ ID NO: 61 - protein, 205 aa, Artificial Sequence
  RGS4
MCKGLAGLPASCLRSAKDMKHRLGFLLQKSDSCEHSSSHSKKDKVVTCQRVSQEEVKKWAESLENLIHHECGLAAFKAFLKSEYSEENIDFWISCEEYKKIKSPSKLSPKAKKIYNEFISVQATKEVNLDSCTREETSRNMLQPTITCFDEAQKKIFNLMEKDSYRRFLKSRFYLDLTNPSSCGAEKQKGAKSSADCTSLVSQCA

SEQ ID NO: 62 - DNA, 2316 bp, Artificial Sequence
  IRX2
aaaccccgaccgccggcctggcgcgcggctgcgcccaccggctccgcgctgctgccgccgccaccgccaccccgccgccgccccggcccgcgggccgcccaggctagtacccgggccggcctgcctccgccggccgtccgggtgcccgccgccgcgccgcgccccggccgggcgtggatggagggcgccgcgcgccctgcccgctgctcggcgtgacgcgggccccgcgccccgcgcccaccatgtcctacccgcagggctacctgtaccaggcgcccggctcgctggcgctctactcgtgcccggcctacggcgcgtcggctttggcggctccgcgcagcgaggagctggcgcgctcggcgtcgggctcggcgttcagcccctacccgggctcggcggccttcacggcgcaggcggccaccggcttcgggagcccgctgcagtactcggccgacgccgccgccgccgccgccggcttcccgtcctacatgggcgcaccctacgacgcgcacaccaccggcatgaccggcgccatcagctaccacccgtacggcagcgcggcctacccgtaccagctcaacgaccccgcgtaccgcaagaacgccacgcgggacgccacggccactctcaaggcctggctcaacgagcaccgcaagaacccctaccccaccaagggcgagaagatcatgctagccatcatcaccaagatgaccctcacccaggtctccacctggttcgccaacgcgcgccggcgcctcaagaaggagaacaagatgacctgggccccgagaaacaaaagcgaagatgaggacgaggacgagggcgacgctaccagaagcaaggacgagagtcccgacaaggcgcaggagggcacggagacctcggcagaggacgaagggatcagcctgcacgtggactcgctcacggatcactcgtgctcggccgagtcggacggggagaagcttccgtgccgcgccggggaccccctgtgcgaatcgggctcggagtgcaaggacaagtatgacgacctggaggacgacgaggacgacgacgaggagggcgagcggggcctggcgccgcccaagcccgtgacctcgtcgccgcttaccggcttggaggcgccgctgctgagccccccgcccgaggccgcgccccgcggtggccgcaagacgccccagggcagccggacgtctccgggcgcgccgccccccgccagcaagcccaagctgtggtcgctggccgagatcgccacgtcggacctcaagcagccgagcctgggcccgggctgcgggccaccggggctgcccgcggccgccgcgccggcctcaaccggggcaccgccaggaggctcgccctaccctgcctcgccgctgctgggccgccccctctactacacgtcgcccttctacggcaactacacaaactacgggaacttgaacgcggcgctgcagggccagggtctcctgcggtacaactctgcggccgcggcccccggcgaggccctgcacaccgcgccaaaggcggccagcgacgcgggcaaggcgggcgcgcacccgctcgagtcccactaccggtccccgggcggcggctacgagcccaagaaagatgccagcgagggctgcaccgtggttggcgggggcgtccagccctacctatagaagggccgagcacagcaatgcaagtaggtgtcacaattgctttgaaaaaaaaaaaaaaaaaaaagtcagcaggccattctctcttcccaagctcataaatttacagatacaacaaacagatgtctaaatccagaccacatcttgtgccactgtaaaagagaaggatccacacagcactgtcagcccacagactctaacaattggaacagactattgttggacatatgtgaatttgttggcatagtatagtttccccgatgtatgtgtgacttttgaaaacaatctgtttttctcaggatatcttgaattgatcacttcattgccacggtatatattctataggtgtgataggatttactgtaaagtttatttgtaaaagatgtacacagtagaaataaaacgtgatggaagaacttgagtacttcagaagtggaaacaaatttgatatttatttttataatgatataaagcttctagtaatttatgcaagttgtattgcaatggaatctaaactttttgtaaataaattctgcctggtttttatttgaacattgctggttatacaatctttgttggttgtttaacacgaattctttactaatttatatcttaaattgtaaataaaaacagactagtctacaataaaaaaaaaaaaaaa

SEQ ID NO: 63 - DNA, 3070 bp, Artificial Sequence
  IRX2
aaaccccgaccgccggcctggcgcgcggctgcgcccaccggctccgcgctgctgccgccgccaccgccaccccgccgccgccccggcccgcgggccgcccaggctagtacccgggccggcctgcctccgccggccgtccgggtgcccgccgccgcgccgcgccccggccgggcgtggatggagggcgccgcgcgccctgcccgctgctcggcgtgacgcgggccccgcgccccgcgcccaccatgtcctacccgcagggctacctgtaccaggcgcccggctcgctggcgctctactcgtgcccggcctacggcgcgtcggctttggcggctccgcgcagcgaggagctggcgcgctcggcgtcgggctcggcgttcagcccctacccgggctcggcggccttcacggcgcaggcggccaccggcttcgggagcccgctgcagtactcggccgacgccgccgccgccgccgccggcttcccgtcctacatgggcgcaccctacgacgcgcacaccaccggcatgaccggcgccatcagctaccacccgtacggcagcgcggcctacccgtaccagctcaacgaccccgcgtaccgcaagaacgccacgcgggacgccacggccactctcaaggcctggctcaacgagcaccgcaagaacccctaccccaccaagggcgagaagatcatgctagccatcatcaccaagatgaccctcacccaggtctccacctggttcgccaacgcgcgccggcgcctcaagaaggagaacaagatgacctgggccccgagaaacaaaagcgaagatgaggacgaggacgagggcgacgctaccagaagcaaggacgagagtcccgacaaggcgcaggagggcacggagacctcggcagaggacgaagggatcagcctgcacgtggactcgctcacggatcactcgtgctcggccgagtcggacggggagaagcttccgtgccgcgccggggaccccctgtgcgaatcgggctcggagtgcaaggacaagtatgacgacctggaggacgacgaggacgacgacgaggagggcgagcggggcctggcgccgcccaagcccgtgacctcgtcgccgcttaccggcttggaggcgccgctgctgagccccccgcccgaggccgcgccccgcggtggccgcaagacgccccagggcagccggacgtctccgggcgcgccgccccccgccagcaagcccaagctgtggtcgctggccgagatcgccacgtcggacctcaagcagccgagcctgggcccgggctgcgggccaccggggctgcccgcggccgccgcgccggcctcaaccggggcaccgccaggaggctcgccctaccctgcctcgccgctgctgggccgccccctctactacacgtcgcccttctacggcaactacacaaactacgggaacttgaacgcggcgctgcagggccagggtctcctgcggtacaactctgcggccgcggcccccggcgaggccctgcacaccgcgccaaaggcggccagcgacgcgggcaaggcgggcgcgcacccgctcgagtcccactaccggtccccgggcggcggctacgagcccaagaaagatgccagcgagggctgcaccgtggttggcgggggcgtccagccctacctatagaagggccgagcacagcaatgcaagtaagtgggcaccctggtgcttcccagaccctgtggagcctcccagcaccaacttgcttaatgtgtttttcttgcttctggtcatggggttagaagacagagcatttcaatcttgtccagcttttctttccttaagggggaaactatattttctgttttatagattccctctttttggcacaagttctatcactcctttacctagggaaggaaaaaaaaaatatatatatatatgtgtgtgtgtgtgtgtgtaatatatatatgtatatatatagtacatgtatatatatagtacatgtgtatatatatattacacactactgttgttttcttttgaaacaatagattattaaaatctgggcatttatatgcaatttagagccatttttactatgctagacacataatagacacatgctttgatgagcttgggctaccaaaacttggagtagcaaaaacctttatagatgatgtttgcaaaataagactgaagagacacgaggcgtactagtcttttatcagccctgtccaacctcccctccacccatgtccaagtggacaggactctgacattctcccggggctcacaacagtatctcaaaaaatatgttgctttgcaacgagtcagaattactaatcatagatcttgaagataagaaagatttggaaccacttcagatcaactcgtttttataatggtgttgttgtggaactgaaagattggggatgatttggttttttccttggtccacaggtaggtgtcacaattgctttgaaaaaaaaaaaaaaaaaaaagtcagcaggccattctctcttcccaagctcataaatttacagatacaacaaacagatgtctaaatccagaccacatcttgtgccactgtaaaagagaaggatccacacagcactgtcagcccacagactctaacaattggaacagactattgttggacatatgtgaatttgttggcatagtatagtttccccgatgtatgtgtgacttttgaaaacaatctgtttttctcaggatatcttgaattgatcacttcattgccacggtatatattctataggtgtgataggatttactgtaaagtttatttgtaaaagatgtacacagtagaaataaaacgtgatggaagaacttgagtacttcagaagtggaaacaaatttgatatttatttttataatgatataaagcttctagtaatttatgcaagttgtattgcaatggaatctaaactttttgtaaataaattctgcctggtttttatttgaacattgctggttatacaatctttgttggttgtttaacacgaattctttactaatttatatcttaaattgtaaataaaaacagactagtctacaataaaaaaaaaaaaaaa

SEQ ID NO: 64 - DNA, 2646 bp, Artificial Sequence
  IRX2
gagcgctccttcctcaactcctcactcctgactgcagactcccccaaatcccgaccgccggcctggcgcgcggctgcgcccaccggctccgcgctgccgctaccgccgccccgccgatcctccagccccgcgcccagcctagcgcccaccagcccagcctgctccggcccgcggcctcggtgcgccccggccgggcgtggatggagggcgccgcgcgcgctgcccgctgctccgtgtgacgcgggccccgcgccccgcgcccaccatgtcctacccgcagggctacctgtaccaagcgcccggctcgctggcgctctactcgtgccccgcgtacggcgcgtccgcgctggcggcgccgcgcagcgaggagctggcgcgttcggcgtcgggctccgcgttcagcccgtaccccggctcggcggccttcacagcgcaggcggcaaccggcttcggcagcccgctgcagtactcggcggacgccgccgccgccgcggctgccggcttcccgtcctacgtgggctcgccatacgacacgcacaccaccggaatgactggcgccatcagctaccatccatatggcagtgcggcctatccataccagctcaacgaccccgcgtaccgtaagaacgctacgcgggacgccactgccacactgaaagcctggctcaacgaacaccgaaagaacccgtaccccaccaagggagagaagatcatgctggccatcatcaccaagatgaccctcacgcaggtctccacctggttcgccaacgcgcgccgacgtctcaagaaggagaacaaaatgacctgggccccaaggaacaaaagcgaggatgaggacgaggacgagggagatgcttccagaagcaaggaggagagttcagacaaggcacaggatggcacagagacctctgcggaggacgaagggatcagtctacacgtcgactcgctcacggaccactcgtgctcagcggagtcagatggggaaaaattgccctgccgcgccggggatgccttgtgcgaatcaggctcagagtgtaaggacaagtttgaggacctggaggacgaggaggacgaggaagacgagtgcgagcgggacctggcgccacccaagcccgtaacctcctcgcctctcaccggcgtggaggcacccctgctgagcccggcgcccgaagccgcgccgcgcggtggcagcggtggcaagacgcccctaggcagccggacgtcgccaggagcgccgccgcccgccagcaaacccaagctgtggtcgctggccgagatagccacgtcggacctcaagcaaccaagcttgggcccgggttgcgggcctccggggctgcctgctgccgccgcgcctgcctcgactggggcccctccgggaggctcgccctactctgcttcgcccctgctgggccgccacctctattacacgtcccctttctatggcaactacacaaactacgggaacttaaacgcagcgctgcaaggccagggccttctgcggtacaataccgcggcctcctcaccaggcgagacactgcacgccatgcccaaggcggccagcgacacgggcaaggcgggctcgcattcactggagtcccactacaggcctccgggcggcggctacgagcccaagaaagataccagtgagggctgtgcagttgttggtgcaggcgtccagacctacctataggagggccaaggtcagcagtgcaagtaggtgtcacaattgctttggaaaaaaaagtcaggaggctattctcccttcccaagttcataaatacacagatacaaaccccagatgtggaaacccggaccacattttgtgccactgtataagaggatgcacactgcactgccaacccacagactctaaggactggacacacgttgtttgggcatatgagaacttgttgtcatagtatagcttccctatgtttgtgtgacttttggaaacaatctgttttttctcaggatatcctcatcacttcattgccacggtatatattctataggtgtgataggacttgctgtaaaatttatttgtaaaaaaaaatgtacacggtagaactaacgtgattgaagaacttgagtccttcagaagtggaaacaaatttgatatttatttttataatgatataaagcttctagtaatttatgcaagttgtattgcaatgaaatctaaaacttttgtaaataaattctgcctggtttttatttgaacattgctggttatacaatctctgttggttgtttaacatcagttctcctattaatttatatctaaaactgtaaataaaaacagacgcgcctacaagaaaatggtgtttggggctcatttttactggagacccatttgggtagaagctccagcggtagccctggttcctgccccaaaggtggtcctacctcaccttttaagtgaagagccagtgaaataaacgtccttcttgagcttatttgaaaaactgcagacctgagagaaattaatgtacaacagggagatacctacggttccagtttattcacatagaaatgtgtttccagaaagtaattcaggtttttttttgttctctgaatatgcaaatccctacttagtgtaaatttctaaaacatggaagaaaacaaaataaaaggatatgccacctc

SEQ ID NO: 65 - protein, 471 aa, Artificial Sequence
  IRX2
MSYPQGYLYQAPGSLALYSCPAYGASALAAPRSEELARSASGSAFSPYPGSAAFTAQAATGFGSPLQYSADAAAAAAGFPSYMGAPYDAHTTGMTGAISYHPYGSAAYPYQLNDPAYRKNATRDATATLKAWLNEHRKNPYPTKGEKIMLAIITKMTLTQVSTWFANARRRLKKENKMTWAPRNKSEDEDEDEGDATRSKDESPDKAQEGTETSAEDEGISLHVDSLTDHSCSAESDGEKLPCRAGDPLCESGSECKDKYDDLEDDEDDDEEGERGLAPPKPVTSSPLTGLEAPLLSPPPEAAPRGGRKTPQGSRTSPGAPPPASKPKLWSLAEIATSDLKQPSLGPGCGPPGLPAAAAPASTGAPPGGSPYPASPLLGRPLYYTSPFYGNYTNYGNLNAALQGQGLLRYNSAAAAPGEALHTAPKAASDAGKAGAHPLESHYRSPGGGYEPKKDASEGCTVVGGGVQPYL

SEQ ID NO: 66 - protein, 471 aa, Artificial Sequence; identical to SEQ ID NO: 65
  IRX2

SEQ ID NO: 67 - protein, 474 aa, Artificial Sequence
  IRX2
MSYPQGYLYQAPGSLALYSCPAYGASALAAPRSEELARSASGSAFSPYPGSAAFTAQAATGFGSPLQYSADAAAAAAAGFPSYVGSPYDTHTTGMTGAISYHPYGSAAYPYQLNDPAYRKNATRDATATLKAWLNEHRKNPYPTKGEKIMLAIITKMTLTQVSTWFANARRRLKKENKMTWAPRNKSEDEDEDEGDASRSKEESSDKAQDGTETSAEDEGISLHVDSLTDHSCSAESDGEKLPCRAGDALCESGSECKDKFEDLEDEEDEEDECERDLAPPKPVTSSPLTGVEAPLLSPAPEAAPRGGSGGKTPLGSRTSPGAPPPASKPKLWSLAEIATSDLKQPSLGPGCGPPGLPAAAAPASTGAPPGGSPYSASPLLGRHLYYTSPFYGNYTNYGNLNAALQGQGLLRYNTAASSPGETLHAMPKAASDTGKAGSHSLESHYRPPGGGYEPKKDTSEGCAVVGAGVQTYL

SEQ ID NO: 68 - DNA, 4867 bp, Artificial Sequence
  LPPR4
gaagccattgcagcaacagcttggaggagggagctggacgtcgtctctcgccagaaaaacggggagcaggagccagactaggggaggaagaggactggcccgctcagggaatagctgggttgctgcaaaaaggggcggggagaaggcgggggcgctgcatgcagcgcgctggctccagcggtggccgcggggaatgtgacatcagcggcgccgggcgcttggggctggaggaggcagctcgcctcagctgcgctgtgcacacctcgcccgggggaggacgcagacccgggcaggcggcagggatgtcggcgaaggagaggccaaagggcaaagtgatcaaggacagcgtcaccctcctgccctgcttttatttcgtcgagttgcctatattggcatcatcggtggttagcctctatttcctcgaactcacagatgtcttcaaacctgtgcactctggatttagctgctatgaccggagtcttagcatgccgtacattgaaccaacccaggaggcaattccattcctcatgttgcttagcttggcttttgctggacctgcaattacgattatggtaggagaaggaattctctactgttgcctctccaaaagaagaaatggggtcggactagagcccaacattaatgctggaggctgcaacttcaattccttcctcagacgagctgtcagattcgttggtgttcatgtatttggattatgctctacagctctcattacagatatcatacagctgtccacaggatatcaagcaccttactttctgactgtgtgcaaaccaaactatacctctctgaatgtatcttgcaaagaaaattcctacattgtggaagatatttgctcaggatctgacctcacagttatcaacagtggcagaaagtccttcccttctcaacatgcaacccttgctgcctttgcagctgtgtatgtttcgggcttgtatgctgtggggaatttcctgcccagtgatgagagtatgtttcagcacagagacgccctcaggtctctgacagacctcaatcaagatcccaaccgacttttatctgctaaaaatggtagcagcagtgatggaattgctcatacagaaggcatcctcaaccgaaaccacagagatgctagctctctgacaaatctcaaaagagcaaatgctgatgtggaaatcattactccacggagccccatggggaaggagaacatggttaccttcagcaataccttgccgcgagccaataccccatctgtagaagaccctgtcagaagaaatgcgagcattcatgcctctatggattccgctcgatcaaagcagctcctcacccagtggaagaataagaatgaaagtcgaaagttgtccttgcaagttatagagcctgagcctgggcagtcaccacccagatccatagaaatgaggtcaagctcagagccatcgagggtaggggtgaatggagaccaccatggtcctggcaatcagtacctcaaaatccagcctggcgctgtccccggatgtaacaacagcatgcctggagggccaagagtgtccattcagtcccgtcctgggtcctcacagttggtgcacatccctgaggagactcaggaaaacataagcacctcccccaaaagcagctctgctcgggccaagtggttaaaagctgctgaaaagactgtggcctgtaacagaagcaacagccagccccgaatcatgcaagtcatagccatgtccaagcagcagggtgtcctccaaagcagccccaagaacactgaaggcagcacggtctcctgcactggctccatccgctataaaaccttgacagaccatgagcccagtgggatagtgagggttgaggctcacccagagaacaacaggcccatcatacagatcccgtccactgaaggtgaaggcagtggctcctggaagtggaaagcccctgaaaagggcagccttcgccaaacttacgagctcaacgatctcaacagggactcagaaagctgtgagtctctgaaagacagctttggttctggagatcgcaagagaagcaacattgatagcaatgagcatcaccaccacggaattaccaccatccgcgtcaccccagtagagggcagcgaaattggctcagagacgctgtccatttcttcttcccgcgactccaccctgcggagaaagggcaatatcattctaatccctgaaagaagcaacagccccgaaaacactagaaatatcttctacaaaggaacctcccccacacgggcttataaggattgagtgatgtccattccatcattagggctactcgcaaaagaccatatgttgattctacctgtgttctgttccagcgaattgggaagtctcaccaagctagattgtctaccatcagcccagaactctgtaacttttcagaactgctatactcaaacttgcagatctcacatcaaggagagggaaaagcacaatgcaagaacctaactaacgtgatgatatgaagagttttcttaagacctgtcgtcaaacttaaaaggttttgcagagggcagtatcaaaagaaagtggttttcttcaaatgtatactattttacttcctgaatgtgccaactttggggatttttctttatagtgagctgtgggaacccagaacacacacgttttccctacagcagaggccatgcagtattatatattcattttgcagaatctgcacctacagctcaatacgggtggtgctgattattatagtacatataccatgtaaactctcaaactctatttagctgtgaaatagtggtgtgcaattccttgttaaagaaatgctactttattaagaagatgctggctgctttgtgttagaataggacaccccgcagcttctctgtagtggctctgtcacagtcaaaaaatgaaaaggtttttgtgcgtttcttcaaaattctgctttcttcaacatcaaaaattgtgtagaaatattttcagtgaaagggaataactagtacttttctgcatagtttttcttctgcttactttttatttaagtataggtactgctaatgaatctgttttcttagtgagtaaatttgcataattttataaatattattttagagaatcttttgaaattgttgtgatcatattttgctttctatggcttctccttaacttattgattaattttttgaagttatagatatgttctcctattttaaaagcaaaaataacaattgacattccttgagcaaaatatactgctgtgaatttgcaaacaagaaatctgagccaaaacttgacattgtgggttacattgccagaaatgttggtcaagtttgcccttagatgtctacaactagctggcataggttgccatcttaacaagtaatctaaaagtcccattcggttctacattattaactttttttttctatatcctgatgaccagtaaattagagccacactggttaagtttgactcgtctctaaaacgtttttgttaattggacaccaagaggaagaatctgaaaaaaaaatgcatgttggtaagtaaaagtatctcacggtacaaattaagaatgactttcttcaaaatatctgaataggtgcagttttagtttaacatgcaaacaaccattgttgctacctatcctgaatcaagccttgagcctaaatcaaagcaaaccaataccattgataagaagaagataaaaacaaaatattttggagtgttttccaacttaaagtatgaagacatactcagttcttggaacttagtattaaaccttttttatgccatttcataagaattccgatatatacttgatgattgccaaggggatgaaaggaaacaacagagatggttgatctgatcttagctcactttccaataacagaaggagttgtttacagatgaatagtatcacatcattatcaatttccacatgaaaaaggtggagctttctagaaaaaccaacctctaaggcattaggaatttagctgaaaccagcagaattgaaaactctggcaataaaacatggactcaaccatatcccttctggcaatttccttctcagagaggggagtgggaataaaatgttgccttccccacttctcaccaccaccgccatcatgacgctcatactggcttttgcctgtttgtagaggaaaaggtgggctggttttagtactctgaaggacaaaaacaagcaaacaaaaacccctgctgcagcatttcaggtgcagtatgatatttcctaatctttcctatttcttaacaaaagattttaaagtacttctctagtcattgaagtttttttttctttacataaatattgatatattctttttctactcaaagtgccaaaggctacagtttttaatgacttaacaaattgtaccacattgttaaggacatataatgatagacactagaactcagacctctgcatgtatatttgataacatgtcttttgtaaaacaaaaattacaaaaaaatttgtttacattccactggtaccttaatttaaaataaatcagactaaaaggtggtatctcttcttagtgttctatttatcttatttgctaatgggagcacttcttcctttgttaggctgtgctttactgataaaaccaagtattgaataaagagagttaattatctttttaaagtaaataaaattatgaaaatatatatagtatatataaagtactgtgtttaaaaaaatgttatgcaatgttttccaaactgataaagtttgtaaagtgctataaatgtattttgttaagtacagataaaagctattgtgtgagtatattgtgctaaaatcatagaaataaagattagatttcttcatcaaaaaaaaaaaaaaaaaaaaa

SEQ ID NO: 69 - DNA, 5040 bp, Artificial Sequence
  LPPR4
gaagccattgcagcaacagcttggaggagggagctggacgtcgtctctcgccagaaaaacggggagcaggagccagactaggggaggaagaggactggcccgctcagggaatagctgggttgctgcaaaaaggggcggggagaaggcgggggcgctgcatgcagcgcgctggctccagcggtggccgcggggaatgtgacatcagcggcgccgggcgcttggggctggaggaggcagctcgcctcagctgcgctgtgcacacctcgcccgggggaggacgcagacccgggcaggcggcagggatgtcggcgaaggagaggccaaagggcaaagtgatcaaggacagcgtcaccctcctgccctgcttttatttcgtcgagttgcctatattggcatcatcggtggttagcctctatttcctcgaactcacagatgtcttcaaacctgtgcactctggatttagctgctatgaccggagtcttagcatgccgtacattgaaccaacccaggaggcaattccattcctcatgttgcttagcttggcttttgctggacctgcaattacgattatggtaggagaaggaattctctactgttgcctctccaaaagaagaaatggggtcggactagagcccaacattaatgctggaggctgcaacttcaattccttcctcagacgagctgtcagattcgttggtgttcatgtatttggattatgctctacagctctcattacagatatcatacagctgtccacaggatatcaagcaccttactttctgactgtgtgcaaaccaaactatacctctctgaatgtatcttgcaaagaaaattcctacattgtggaagatatttgctcaggatctgacctcacagttatcaacagtggcagaaagtccttcccttctcaacatgcaacccttgctgcctttgcagctgtgtatgtttcgatgtacttcaattccacattaacggattcctctaagcttctgaaacctctcttggtcttcacatttatcatctgtggaataatctgcgggctaacacggataactcagtataagaaccacccagttgatgtctattgtggctttttaataggaggaggaattgcactgtacttgggcttgtatgctgtggggaatttcctgcccagtgatgagagtatgtttcagcacagagacgccctcaggtctctgacagacctcaatcaagatcccaaccgacttttatctgctaaaaatggtagcagcagtgatggaattgctcatacagaaggcatcctcaaccgaaaccacagagatgctagctctctgacaaatctcaaaagagcaaatgctgatgtggaaatcattactccacggagccccatggggaaggagaacatggttaccttcagcaataccttgccgcgagccaataccccatctgtagaagaccctgtcagaagaaatgcgagcattcatgcctctatggattccgctcgatcaaagcagctcctcacccagtggaagaataagaatgaaagtcgaaagttgtccttgcaagttatagagcctgagcctgggcagtcaccacccagatccatagaaatgaggtcaagctcagagccatcgagggtaggggtgaatggagaccaccatggtcctggcaatcagtacctcaaaatccagcctggcgctgtccccggatgtaacaacagcatgcctggagggccaagagtgtccattcagtcccgtcctgggtcctcacagttggtgcacatccctgaggagactcaggaaaacataagcacctcccccaaaagcagctctgctcgggccaagtggttaaaagctgctgaaaagactgtggcctgtaacagaagcaacagccagccccgaatcatgcaagtcatagccatgtccaagcagcagggtgtcctccaaagcagccccaagaacactgaaggcagcacggtctcctgcactggctccatccgctataaaaccttgacagaccatgagcccagtgggatagtgagggttgaggctcacccagagaacaacaggcccatcatacagatcccgtccactgaaggtgaaggcagtggctcctggaagtggaaagcccctgaaaagggcagccttcgccaaacttacgagctcaacgatctcaacagggactcagaaagctgtgagtctctgaaagacagctttggttctggagatcgcaagagaagcaacattgatagcaatgagcatcaccaccacggaattaccaccatccgcgtcaccccagtagagggcagcgaaattggctcagagacgctgtccatttcttcttcccgcgactccaccctgcggagaaagggcaatatcattctaatccctgaaagaagcaacagccccgaaaacactagaaatatcttctacaaaggaacctcccccacacgggcttataaggattgagtgatgtccattccatcattagggctactcgcaaaagaccatatgttgattctacctgtgttctgttccagcgaattgggaagtctcaccaagctagattgtctaccatcagcccagaactctgtaacttttcagaactgctatactcaaacttgcagatctcacatcaaggagagggaaaagcacaatgcaagaacctaactaacgtgatgatatgaagagttttcttaagacctgtcgtcaaacttaaaaggttttgcagagggcagtatcaaaagaaagtggttttcttcaaatgtatactattttacttcctgaatgtgccaactttggggatttttctttatagtgagctgtgggaacccagaacacacacgttttccctacagcagaggccatgcagtattatatattcattttgcagaatctgcacctacagctcaatacgggtggtgctgattattatagtacatataccatgtaaactctcaaactctatttagctgtgaaatagtggtgtgcaattccttgttaaagaaatgctactttattaagaagatgctggctgctttgtgttagaataggacaccccgcagcttctctgtagtggctctgtcacagtcaaaaaatgaaaaggtttttgtgcgtttcttcaaaattctgctttcttcaacatcaaaaattgtgtagaaatattttcagtgaaagggaataactagtacttttctgcatagtttttcttctgcttactttttatttaagtataggtactgctaatgaatctgttttcttagtgagtaaatttgcataattttataaatattattttagagaatcttttgaaattgttgtgatcatattttgctttctatggcttctccttaacttattgattaattttttgaagttatagatatgttctcctattttaaaagcaaaaataacaattgacattccttgagcaaaatatactgctgtgaatttgcaaacaagaaatctgagccaaaacttgacattgtgggttacattgccagaaatgttggtcaagtttgcccttagatgtctacaactagctggcataggttgccatcttaacaagtaatctaaaagtcccattcggttctacattattaactttttttttctatatcctgatgaccagtaaattagagccacactggttaagtttgactcgtctctaaaacgtttttgttaattggacaccaagaggaagaatctgaaaaaaaaatgcatgttggtaagtaaaagtatctcacggtacaaattaagaatgactttcttcaaaatatctgaataggtgcagttttagtttaacatgcaaacaaccattgttgctacctatcctgaatcaagccttgagcctaaatcaaagcaaaccaataccattgataagaagaagataaaaacaaaatattttggagtgttttccaacttaaagtatgaagacatactcagttcttggaacttagtattaaaccttttttatgccatttcataagaattccgatatatacttgatgattgccaaggggatgaaaggaaacaacagagatggttgatctgatcttagctcactttccaataacagaaggagttgtttacagatgaatagtatcacatcattatcaatttccacatgaaaaaggtggagctttctagaaaaaccaacctctaaggcattaggaatttagctgaaaccagcagaattgaaaactctggcaataaaacatggactcaaccatatcccttctggcaatttccttctcagagaggggagtgggaataaaatgttgccttccccacttctcaccaccaccgccatcatgacgctcatactggcttttgcctgtttgtagaggaaaaggtgggctggttttagtactctgaaggacaaaaacaagcaaacaaaaacccctgctgcagcatttcaggtgcagtatgatatttcctaatctttcctatttcttaacaaaagattttaaagtacttctctagtcattgaagtttttttttctttacataaatattgatatattctttttctactcaaagtgccaaaggctacagtttttaatgacttaacaaattgtaccacattgttaaggacatataatgatagacactagaactcagacctctgcatgtatatttgataacatgtcttttgtaaaacaaaaattacaaaaaaatttgtttacattccactggtaccttaatttaaaataaatcagactaaaaggtggtatctcttcttagtgttctatttatcttatttgctaatgggagcacttcttcctttgttaggctgtgctttactgataaaaccaagtattgaataaagagagttaattatctttttaaagtaaataaaattatgaaaatatatatagtatatataaagtactgtgtttaaaaaaatgttatgcaatgttttccaaactgataaagtttgtaaagtgctataaatgtattttgttaagtacagataaaagctattgtgtgagtatattgtgctaaaatcatagaaataaagattagatttcttcatcaaaaaaaaaaaaaaaaaaaa

SEQ ID NO: 70 - protein, 705 aa, Artificial Sequence
  LPPR4
MQRAGSSGGRGECDISGAGRLGLEEAARLSCAVHTSPGGGRRPGQAAGMSAKERPKGKVIKDSVTLLPCFYFVELPILASSVVSLYFLELTDVFKPVHSGFSCYDRSLSMPYIEPTQEAIPFLMLLSLAFAGPAITIMVGEGILYCCLSKRRNGVGLEPNINAGGCNFNSFLRRAVRFVGVHVFGLCSTALITDIIQLSTGYQAPYFLTVCKPNYTSLNVSCKENSYIVEDICSGSDLTVINSGRKSFPSQHATLAAFAAVYVSGLYAVGNFLPSDESMFQHRDALRSLTDLNQDPNRLLSAKNGSSSDGIAHTEGILNRNHRDASSLTNLKRANADVEIITPRSPMGKENMVTFSNTLPRANTPSVEDPVRRNASIHASMDSARSKQLLTQWKNKNESRKLSLQVIEPEPGQSPPRSIEMRSSSEPSRVGVNGDHHGPGNQYLKIQPGAVPGCNNSMPGGPRVSIQSRPGSSQLVHIPEETQENISTSPKSSSARAKWLKAAEKTVACNRSNSQPRIMQVIAMSKQQGVLQSSPKNTEGSTVSCTGSIRYKTLTDHEPSGIVRVEAHPENNRPIIQIPSTEGEGSGSWKWKAPEKGSLRQTYELNDLNRDSESCESLKDSFGSGDRKRSNIDSNEHHHHGITTIRVTPVEGSEIGSETLSISSSRDSTLRRKGNIILIPERSNSPENTRNIFYKGTSPTRAYKD

SEQ ID NO: 71 - protein, 763 aa, Artificial Sequence
  LPPR4
MQRAGSSGGRGECDISGAGRLGLEEAARLSCAVHTSPGGGRRPGQAAGMSAKERPKGKVIKDSVTLLPCFYFVELPILASSVVSLYFLELTDVFKPVHSGFSCYDRSLSMPYIEPTQEAIPFLMLLSLAFAGPAITIMVGEGILYCCLSKRRNGVGLEPNINAGGCNFNSFLRRAVRFVGVHVFGLCSTALITDIIQLSTGYQAPYFLTVCKPNYTSLNVSCKENSYIVEDICSGSDLTVINSGRKSFPSQHATLAAFAAVYVSMYFNSTLTDSSKLLKPLLVFTFIICGIICGLTRITQYKNHPVDVYCGFLIGGGIALYLGLYAVGNFLPSDESMFQHRDALRSLTDLNQDPNRLLSAKNGSSSDGIAHTEGILNRNHRDASSLTNLKRANADVEIITPRSPMGKENMVTFSNTLPRANTPSVEDPVRRNASIHASMDSARSKQLLTQWKNKNESRKLSLQVIEPEPGQSPPRSIEMRSSSEPSRVGVNGDHHGPGNQYLKIQPGAVPGCNNSMPGGPRVSIQSRPGSSQLVHIPEETQENISTSPKSSSARAKWLKAAEKTVACNRSNSQPRIMQVIAMSKQQGVLQSSPKNTEGSTVSCTGSIRYKTLTDHEPSGIVRVEAHPENNRPIIQIPSTEGEGSGSWKWKAPEKGSLRQTYELNDLNRDSESCESLKDSFGSGDRKRSNIDSNEHHHHGITTIRVTPVEGSEIGSETLSISSSRDSTLRRKGNIILIPERSNSPENTRNIFYKGTSPTRAYKD

SEQ ID NO: 72 - DNA, 3810 bp, Artificial Sequence
  LOXL2
gcggcggccgccttcggggaagggggtgggtccggggaggggtttgccatcctcctctagttaaaagtaagggggaaaagagtaaacgcgcgactccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagagaacctgaatatccaggtggaggacattcggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaaaatgtttgcctcacggaggaagcagcgctactggccattctccatggactgcaccggcacagaggcccacatctccagctgcaagctgggcccccaggtgtcactggaccccatgaagaatgtcacctgcgagaatgggctaccggccgtggtgagttgtgtgcctgggcaggtcttcagccctgacggaccctcaagattccggaaagcgtacaagccagagcaacccctggtgcgactgagaggcggtgcctacatcggggagggccgcgtggaggtgctcaaaaatggagaatgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccaggagacctggtattggcacggagatgtcaacagcaacaaagtggtcatgagtggagtgaagtgctcgggaacggagctgtccctggcgcactgccgccacgacggggaggacgtggcctgcccccagggcggagtgcagtacggggccggagttgcctgctcagaaaccgcccctgacctggtcctcaatgcggagatggtgcagcagaccacctacctggaggaccggcccatgttcatgctgcagtgtgccatggaggagaactgcctctcggcctcagccgcgcagaccgaccccaccacgggctaccgccggctcctgcgcttctcctcccagatccacaacaatggccagtccgacttccggcccaagaacggccgccacgcgtggatctggcacgactgtcacaggcactaccacagcatggaggtgttcacccactatgacctgctgaacctcaatggcaccaaggtggcagagggccacaaggccagcttctgcttggaggacacagaatgtgaaggagacatccagaagaattacgagtgtgccaacttcggcgatcagggcatcaccatgggctgctgggacatgtaccgccatgacatcgactgccagtgggttgacatcactgacgtgccccctggagactacctgttccaggttgttattaaccccaacttcgaggttgcagaatccgattactccaacaacatcatgaaatgcaggagccgctatgacggccaccgcatctggatgtacaactgccacataggtggttccttcagcgaagagacggaaaaaaagtttgagcacttcagcgggctcttaaacaaccagctgtccccgcagtaaagaagcctgcgtggtcaactcctgtcttcaggccacaccacatcttccatgggacttccccccaacaactgagtctgaacgaatgccacgtgccctcacccagcccggcccccaccctgtccagacccctacagctgtgtctaagctcaggaggaaagggaccctcccatcattcatggggggctgctacctgacccttggggcctgagaaggccttgcgggggtggggtttgtccacagagctgctggagcagcaccaagagccagtcttgaccgggatgaggcccacagacaggttgtcatcagcttgtcccattcaagccaccgagctcaccacagacacagtggagccgcgctcttctccagtgacacgtggacaaatgcgggctcatcagcccccccagagagggtcaggccgaaccccatttctcctcctcttaggtcattttcagcaaacttgaatatctagacctctcttccaatgaaaccctccagtctattatagtcacatagataatggtgccacgtgttttctgatttggtgagctcagacttggtgcttccctatccacagcccccaccccttgtttttcaagatactattattatattttcacagacttttgaagcacaaatttattggcatttaatattggacatctgggcccttggaagtacaaatctaaggaaaaaccaacccactgtgtaagtgactcatcttcctgttgttccaattctgtgggtttttgattcaacggtgctataaccagggtcctgggtgacagggcgctcactgagcaccatgtgtcatcacagacacttacacatacttgaaacttggaataaaagaaagatttatgaaacgtgtctgtgtttcctttgacccacagcacctgggccctgagcagcaggcttcctatgttcagtggccagaagcagagcttcaggtacattcgtggttttctccggtggacatgggtcctcagatcccctccagcccagtgtggccaccagggcacctccttcaatagactccaaaaggggcagctcctaccatctgggagaagcaatctaaggagatcacaaaaagtaacggaacaggagtcataatctttcttgaactcctgtggtttttactgaaacttg

SEQ ID NO: 73 - protein, 774 aa, Artificial Sequence
  LOXL2
MERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIENLNIQVEDIRIRAILSTYRKRTPVMEGYVEVKEGKTWKQICDKHWTAKNSRVVCGMFGFPGERTYNTKVYKMFASRRKQRYWPFSMDCTGTEAHISSCKLGPQVSLDPMKNVTCENGLPAVVSCVPGQVFSPDGPSRFRKAYKPEQPLVRLRGGAYIGEGRVEVLKNGEWGTVCDDKWDLVSASVVCRELGFGSAKEAVTGSRLGQGIGPIHLNEIQCTGNEKSIIDCKFNAESQGCNHEEDAGVRCNTPAMGLQKKLRLNGGRNPYEGRVEVLVERNGSLVWGMVCGQNWGIVEAMVVCRQLGLGFASNAFQETWYWHGDVNSNKVVMSGVKCSGTELSLAHCRHDGEDVACPQGGVQYGAGVACSETAPDLVLNAEMVQQTTYLEDRPMFMLQCAMEENCLSASAAQTDPTTGYRRLLRFSSQIHNNGQSDFRPKNGRHAWIWHDCHRHYHSMEVFTHYDLLNLNGTKVAEGHKASFCLEDTECEGDIQKNYECANFGDQGITMGCWDMYRHDIDCQWVDITDVPPGDYLFQVVINPNFEVAESDYSNNIMKCRSRYDGHRIWMYNCHIGGSFSEETEKKFEHFSGLLNNQLSPQ

SEQ ID NO: 74 - DNA, 3657 bp, Artificial Sequence
  LOXL4
ggctggggggccgcgggcgggaggcggataaaaaggccccagggcgcccggggagggagcccgttagcgctgctccgccgcggcgcccgcccagccccggactgtccgcgctccatctggtatcttggcctcagctgtccttgaagtcaccatggcgtggtccccaccagccaccctctttctgttcctgctgctgctaggccagccccctcccagcaggccacagtcactgggcaccactaagctccggctggtgggcccagagagcaagccagaggagggccgcctggaggtgctgcaccagggccagtggggcaccgtgtgtgatgacaactttgctatccaggaggccacagtggcttgccgccagctgggcttcgaagctgccttgacctgggcccacagtgccaagtacggccaaggggagggacccatctggctggacaatgtgcgctgtgtgggcacagagagctccttggaccagtgcgggtctaatggctggggagtcagtgactgcagtcactcagaagacgtaggggtgatatgccacccccggcgccatcgtggctacctttctgaaactgtctccaatgcccttgggccccagggccggcggctggaggaggtgcggctcaagcccatccttgccagtgccaagcagcatagcccagtgaccgagggagccgtggaggtgaagtatgagggccactggcggcaggtgtgtgaccagggctggaccatgaacaacagcagggtggtgtgcgggatgctgggcttccccagcgaggtgcctgtcgacagccactactacaggaaagtctgggatctgaagatgagggaccctaagtctaggctgaagagcctgacgaataagaactccttctggatccaccaggtcacctgcctggggacagagccccacatggccaactgccaggtgcaggtggctccagcccggggcaagctgcggccagcctgcccaggtggcatgcacgctgtggtcagctgtgtggcagggcctcacttccgcccaccgaagacaaagccacaacgcaaagggtcctgggcagaggagccgagggtgcgcctgcgctccggggcccaggtgggcgagggccgggtggaagtgctcatgaaccgccagtggggcacggtctgtgaccacaggtggaacctcatctctgccagtgtcgtgtgtcgtcagctgggctttggctctgctcgggaggccctctttggggcccggctgggccaagggctagggcccatccacctgagtgaggtgcgctgcaggggatatgagcggaccctcagcgactgccctgccctggaagggtcccagaatggttgccaacatgagaatgatgctgctgtcaggtgcaatgtccctaacatgggctttcagaatcaggtgcgcttggctggtgggcgtatccctgaggaggggctattggaggtgcaggtggaggtgaacggggtcccacgctgggggagcgtgtgcagtgaaaactgggggctcaccgaagccatggtggcctgccgacagctcggcctgggttttgccatccatgcctacaaggaaacctggttctggtcggggacgccaagggcccaggaggtggtgatgagtggggtgcgctgctcaggcacagagctggccctgcagcagtgccagaggcacgggccggtgcactgctcccacggtggcgggcgcttcctggctggagtctcctgcatggacagtgcaccagacctggtgatgaacgcccagctagtgcaggagacggcctacttggaggaccgcccgctcagccagctgtattgtgcccacgaggagaactgcctctccaagtctgcggatcacatggactggccctacggataccgccgcctattgcgcttctccacacagatctacaatctgggccggactgactttcgtccaaagactggacgcgatagctgggtttggcaccagtgccacaggcattaccacagcattgaggtcttcacccactacgacctcctcactctcaatggctccaaggtggctgaggggcacaaggccagcttctgtctggaggacacaaactgccccacaggactgcagcggcgctacgcatgtgccaactttggagaacagggagtgactgtaggctgctgggacacctaccggcatgacattgattgccagtgggtggatatcacagatgtgggccccgggaattatatcttccaggtgattgtgaacccccactatgaagtggcagagtcagatttctccaacaatatgctgcagtgccgctgcaagtatgatgggcaccgggtctggctgcacaactgccacacagggaattcatacccagccaatgcagaactctccctggagcaggaacagcgtctcaggaacaacctcatctgaagctgtcactgcacactcctagctgctgccgatacaccagatacctcagcttattggagccatgcccttcacagagtcccaactcagaggaaaagggccagtgccaaggggcaccaagaacctgctcaggaagccttttgatggcaagatcaccaatccagatggtattgctccctcaggatggctctgggcctgcccctaagggcctgtggcctatggaatatgtcctccaggctttgctcagctgagctcctcttctgtaaggaaacccagtcatccctgaatcttgccacagagatccgggattcaggagctctcagtttcttagggatggactatggcccagtcccccatctaagtggtgctttgcaaatgtcttggaggagtataggacagaggaccaaaatacacagcaggtagtgttagctctctgctaggagctcaaagcaacacaacttgtatcaaaatcacaactggcagagaagctggtggatccaatcctttcttcatctgttgttatttagaactcacctctcacactctgttctttagtgtccttacctttatcttaccacacacatgggtgtttctattatccttggaagcacagacctcgggcatccccttattgcctgatgggccaacaccaacagttacggagtgcttgagaaggggcaagtttcacagaaatggccagatagggccttcctacagagcagcaagagtaggccaagcagaaagactgctgaggtaacacggaccccagcccctgtcagggcctctgccaaggaaataatatggaccatttacctggcaggcagtctgctctctctcaggatcaccacgcatctcaggattggtctaaacttcaagtctcaaccaagtgtctgaagtgaactttgcattgaataaatttttgccatggaaagaacatcaaacaagccactcatctctacagagataagaaaacaagtttggcagagcaagagacagaagaccgtggagaaatcagaagggggaacagtcagtttagttaaggatggaacctgggaaaggccaccattcctgcttgatggggctctgatttgctcttgctcaagtggaataaaaccccatggtcttcttgacatgattcttgatcttttctccactgagacacacttaagtgatgatccttacaggactgacaccctaatgccaataaaagttgctcattatggactgctacaaagacc

SEQ ID NO: 75 - protein, 756 aa, Artificial Sequence
  LOXL4
MAWSPPATLFLFLLLLGQPPPSRPQSLGTTKLRLVGPESKPEEGRLEVLHQGQWGTVCDDNFAIQEATVACRQLGFEAALTWAHSAKYGQGEGPIWLDNVRCVGTESSLDQCGSNGWGVSDCSHSEDVGVICHPRRHRGYLSETVSNALGPQGRRLEEVRLKPILASAKQHSPVTEGAVEVKYEGHWRQVCDQGWTMNNSRVVCGMLGFPSEVPVDSHYYRKVWDLKMRDPKSRLKSLTNKNSFWIHQVTCLGTEPHMANCQVQVAPARGKLRPACPGGMHAVVSCVAGPHFRPPKTKPQRKGSWAEEPRVRLRSGAQVGEGRVEVLMNRQWGTVCDHRWNLISASVVCRQLGFGSAREALFGARLGQGLGPIHLSEVRCRGYERTLSDCPALEGSQNGCQHENDAAVRCNVPNMGFQNQVRLAGGRIPEEGLLEVQVEVNGVPRWGSVCSENWGLTEAMVACRQLGLGFAIHAYKETWFWSGTPRAQEVVMSGVRCSGTELALQQCQRHGPVHCSHGGGRFLAGVSCMDSAPDLVMNAQLVQETAYLEDRPLSQLYCAHEENCLSKSADHMDWPYGYRRLLRFSTQIYNLGRTDFRPKTGRDSWVWHQCHRHYHSIEVFTHYDLLTLNGSKVAEGHKASFCLEDTNCPTGLQRRYACANFGEQGVTVGCWDTYRHDIDCQWVDITDVGPGNYIFQVIVNPHYEVAESDFSNNMLQCRCKYDGHRVWLHNCHTGNSYPANAELSLEQEQRLRNNLI

SEQ ID NO: 76 - DNA, 6255 bp, Artificial Sequence
  KCTD12
actcgcctggagcgcgcgggcaaggcgggcggagcgcactggaactcaagggggcgcacagcggcgcgctcgcaccgctcggctccgcgcggctctaggaggtggcggcggtggcggtggcggcggtggcggcggcggcggcggcggggcgcagggctgagcgagcgtccgggttccggggctccggggaaggcggttgcagctcctgagtgcagcgcggcttcctgccactgtcccggcccggccacctctctgtcatggctctggcggacagcacacgtggattacccaacgggggcggcggcgggggcggcagtggctcctcgtcgtcctccgcggagccaccgctcttccccgacatcgtggagctgaacgtggggggccaggtgtacgtgacccggcgctgcacggtggtgtcggtgcccgactcgctgctctggcgcatgttcacgcagcagcagccgcaggagctggcccgggacagcaaaggccgcttctttctggaccgggacggcttcctcttccgctacatcctggattacctgcgggacttgcagctcgtgctgcccgactacttccccgagcgcagccggctgcagcgcgaggccgagtacttcgagctgccagagctcgtgcgccgcctcggggcgccccagcagcccggcccggggccgccgccctcgcggcgcggggtgcacaaggagggctcgctgggtgacgagctgctgccgcttggctactcggagcccgaacagcaggagggcgcctctgccggggcgccgtcgcccacgctggagctggctagccgcagtccgtccgggggcgcggcgggcccgctgctcacgccgtcccagtcgctggacggcagccggcgctcgggctacatcaccatcggctaccgcggctcctacaccatcgggcgggacgcgcaggcggacgccaagttccggcgagtggcgcgcatcaccgtttgcggaaagacgtcgctggccaaggaggtgtttggggacaccctgaacgaaagccgggaccccgaccgtcccccggagcgctacacctcgcgctattacctcaagttcaacttcctggagcaggccttcgacaagctgtccgagtcgggcttccacatggtggcgtgcagctccacgggcacctgcgcctttgccagcagcaccgaccagagcgaggacaagatctggaccagctacaccgagtacgtcttctgcagggagtgagctccccagaccccctcgccactccagcgcccagtccttctcctgcccgagagatgattacagagcctcttgtcccacctttgtcccctggctgctgccctcccattctccccctccagtagtagctgggtgagacctgtccgcccaccttccctccactacagaacctgcagccgcaaatcctctgggctgcttcgtcttctttggacctcctgaaccgagagaacccagaggaacccccaccccacccccacctaccactccatgctttctctactccctgcctcaaaccacccctcccccagatggtacttcagtttggatctattgggggagtgtggccacagaccgggggatgattgaattgttcagaacctgattggaccgtgtccaatgtgcggaagatttccttgaaatcttctcaagctcttatgactcactgggggtttaagagatcaggattggttccactgtctggggttagtgttttacaaggtcattacacagtctttttgacctcttttgaaggtagagttttagaaggctggatggaagattctgagcctggaattaggaccccatggaggcagttcagtaactaaactaataaagttttgaaaagttacacgtaaagtagaagaatctagtgcgtgggacagtaaaggatcctttctcgtacagaataaaaggtctcagcctgtagcttaaacttatagaaagtgatccgcctgcctgcagaggcgcccttttcagctgctgctcgccagaagcccttgattccactggttgacatggcagcagttactggcaagagggagaaaggacgctgccgcctaagagtgcaaggctgctcaggtctccaagcgccgtaggaggtcacctggcagtgactgtagggagctgggtcatagtgcacgtcgtgggtattaggaaagcctgtattctttcaatgaatgtcagtaggaccttcctttagctgtaagacttggtgggcggggtggggtggggagggaggaaagggtaggaagggtgggaagggagaagcagacatagtcatttatgatttgaaagttggaagtttgtaccatctgtttgagtatatgcacatttaaaaaatatcatatagtaaatgcaaacatgccaagtattttataaagattaataacagacctactcttacctggcagtttacttaacttactgttttgagtcctaaacttagagttgttaatgcttatatataatctaaccaaagagttacccagtagggttttagtttttgaacttttattttcttgttgattataaatcctgattttggaatctattgcgcaaaagaagtttcattttggttacttagacctaagatcacttattaaaaatccttattttctccaagcccagcaaacgttgacttctgggcaaacctgaaaacctgaaaatgccactttcatgcagtttgtttgaagttaagtggaatcctttcaaatgacgagctgcagagaactcagcaccaagggctgcctatctgtagatagctgtaaaatggaatatttttaaatgaaggcaaataagtacttaaaagtgagctgagcaataaaatggtccaataataggtaaatgcaacagaaacagaaggagacctggttgccttatgcctttactcttacatggaataaattcccaatgcatatcctatgtaaaccataagtgaagggaaataaacctcgtcatgctccatgctgtgaggtgtcctttggatattctgtgatgacagagaagcctattttgttttgttttcagcatctttctctgatgtacgtttttaaggattttgtaagagctgttttcagtgtttaaattagtgctatttttccttgtttttaaaaatgaatctcgtactgtatcttactatgtccatacagatgttacaaatcgacagttttattcttagactcatgtgatccaagctgtatataccatatataaacattttacatgaatcatttagttttttaattcatttactaatgctataaaatttcctatattaccccagtaatttgcatcagctggtttatatactaaagcaacatgttttgatgagtttcttacatccttatcgaggaattgggttaggaaaaaatacataattgtaaaactgagtttgctgtattatactttttttcttgagtattagttgtattactaatcatatgttgattaactgtctacttaaagtcaaggtacctgtatttttaatccactaatttttttttagttgggaaatagatttcaggtcttttattagactaacattttttgagaagtaaaattgacttcatatacaaagcctgtaattttaggcgaaatggaagcagaaatctaggaagttgtgcttgcttgtatgttgagtttggtctcagactaagtaatgcatcagaattcatctgtttgaagcctgaaataatttaggactctgattcactgaccaaaagtcagtgttgcagagatttctctaccccgtatggtattttgttagattgttcaacaggaagcacatgattgagaacatcttgggacagaccaaaaccactgacagatggcaaggctcggcgattctgatttcccttctcaaatctgctcaactccaagagtcttgagaaactgctaaaattttgcctctgtcactcaagtcttacaaatgttatcttgtaaacctttgaggtgaactattccactgtcttgtacataggcatcttattcactgcaccctgtcacacccagcaccccccgccccgcacattatttgaaagactgggaatttaatggttagggacagtaaatctacttctttttccagggacgactgtcccctctaaagttaaagtcaatacaagaaaactgtctatttttagcctaaagtaaaggctgtgaagaaaattcattttacattgggtagacagtaaaaaacaagtaaaataacttgacatgagcacctttagatcccttcccctccatgggctttgggccacagaatgaacctttgaggcctgtaaagtggattgtaatttcctataagctgtaatagtggaggtattgtgggttcatttgagtaagccctccaaagataccattcaaataacctgggagaatgtcataaattattcagataattaacactgcatgaatctgattcagaggcatgcatttacatatgttgccctaattaccatttgatgatcataaatacaagtgaatgacattggacttttagtaacaaacttaatttttaaaaaggtgtagacaatggtggttaaaaaaaaaaaaaaaacaggtaccaggttctgtgtgtttgcaccaagtaattgacatgttttttaatacatgtggaccatgaacagtattcattctactttttcaaatgatatgctgtagaaaatattccttgaagatgtgagatttaaaaatttttccctttcaatgttgttatgtattctactggtttttgattgatagcacagtgataaatcataatactagacaaaattgtcttctctttcaaaccagagccatatatatgtctgtatatatgggacctactgcttctctgaggaaatgcataatctgttaatatcagacaaaatgagcaattggcagtgctcataatatattccaatttttattggaattttcgatggaatgttatttcaataaagccatgtaaggtgaaactttgataactttttactcttcaagttagggtaaattctgatccaatattcaattcatttgtgtactcccacatgcaaaatgctaaattacaatgcagacattaagaaaaagtattgactggaggggttgaattccttgagaatttattttatagtctaaatcacaaatactttactcaatttagtttttaaaatagtaaactgaatatttttgttgtaagcctatcagagtcaatccttcgtttggaattgttttcctgtttttccttactataaatcatttaaaaactgaattcattttcttagatggcataagtctgtctcttgagaaataagtaaaatactcctattttcagtatctgtagcacctgaaataggtctttgtatagccagaaacaagttatgttgaagttagcttttctttgtcaacagttttggacaataaaaatctgaaagtattaacacttgattttctactggggcccttcaaacttggttggaagaaattcaaccagaatatctacattagagtataatcatgtgtggtaggaagatggactagttaatcaagatttgttgtcacttaaattttttgtgatttttttccaagccagtttttttaaattctaaatgtgttttgaggtatgggtacattaattgtaatgtaaactattatacaactgtttttgcgactttataggcaggtaaattttgctattactattgaatacaaatgacaattcatttatgaccactcaaacagcgttagtaaccatttagtgacaaaggattaaaacatccatctggatgttaattttgaagatgtaaattatatgttgtttaaatttttccaggcatctgaaaaccttatctgctagacaatgtaagattcacacagagttatctgggattctgattttttaaatagtacatatcattaaaccattttctctaaatgtaagaagagcagaaaaaatcttataagattatcagatttttctaatgacacagaaatgtaagaaaaaaatccctttatattgaaaaaagatgcagtcaaagtcttttcagacatgcccaaactttgagaatttcttcaaccatctaatgctataaagatttttgttcttcctgttcacaaccagttgtataacagaaatactagctactgttttccttcctgtgtgtgaagtaatgaatcattgattatgtgacttgttatgtattcaattaaacactaaagaataaaacattcactcctttaattattcaaaaaaaaaaaaaaaaaa

SEQ ID NO: 77 - protein, 325 aa, Artificial Sequence
  KCTD12
MALADSTRGLPNGGGGGGGSGSSSSSAEPPLFPDIVELNVGGQVYVTRRCTVVSVPDSLLWRMFTQQQPQELARDSKGRFFLDRDGFLFRYILDYLRDLQLVLPDYFPERSRLQREAEYFELPELVRRLGAPQQPGPGPPPSRRGVHKEGSLGDELLPLGYSEPEQQEGASAGAPSPTLELASRSPSGGAAGPLLTPSQSLDGSRRSGYITIGYRGSYTIGRDAQADAKFRRVARITVCGKTSLAKEVFGDTLNESRDPDRPPERYTSRYYLKFNFLEQAFDKLSESGFHMVACSSTGTCAFASSTDQSEDKIWTSYTEYVFCRE

SEQ ID NO: 78 - DNA, 5012 bp, Artificial Sequence
  KL
cgcgcagcatgcccgccagcgccccgccgcgccgcccgcggccgccgccgccgtcgctgtcgctgctgctggtgctgctgggcctgggcggccgccgcctgcgtgcggagccgggcgacggcgcgcagacctgggcccgtttctcgcggcctcctgcccccgaggccgcgggcctcttccagggcaccttccccgacggcttcctctgggccgtgggcagcgccgcctaccagaccgagggcggctggcagcagcacggcaagggtgcgtccatctgggatacgttcacccaccaccccctggcacccccgggagactcccggaacgccagtctgccgttgggcgccccgtcgccgctgcagcccgccaccggggacgtagccagcgacagctacaacaacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggctcatgccaaagtctggcatctctacaatacttctttccgtcccactcagggaggtcaggtgtccattgccctaagctctcactggatcaatcctcgaagaatgaccgaccacagcatcaaagaatgtcaaaaatctctggactttgtactaggttggtttgccaaacccgtatttattgatggtgactatcccgagagcatgaagaataacctttcatctattctgcctgattttactgaatctgagaaaaagttcatcaaaggaactgctgacttttttgctctttgctttggacccaccttgagttttcaacttttggaccctcacatgaagttccgccaattggaatctcccaacctgaggcaactgctttcctggattgaccttgaatttaaccatcctcaaatatttattgtggaaaatggctggtttgtctcagggaccaccaagagagatgatgccaaatatatgtattacctcaaaaagttcatcatggaaaccttaaaagccatcaagctggatggggtggatgtcatcgggtataccgcatggtccctcatggatggtttcgagtggcacagaggttacagcatcaggcgtggactcttctatgttgactttctaagccaggacaagatgttgttgccaaagtcttcagccttgttctaccaaaagctgatagagaaaaatggcttccctcctttacctgaaaatcagcccctagaagggacatttccctgtgactttgcttggggagttgttgacaactacattcaagtagataccactctgtctcagtttaccgacctgaatgtttacctgtgggatgtccaccacagtaaaaggcttattaaagtggatggggttgtgaccaagaagaggaaatcctactgtgttgactttgctgccatccagccccagatcgctttactccaggaaatgcacgttacacattttcgcttctccctggactgggccctgattctccctctgggtaaccagtcccaggtgaaccacaccatcctgcagtactatcgctgcatggccagcgagcttgtccgtgtcaacatcaccccagtggtggccctgtggcagcctatggccccgaaccaaggactgccgcgcctcctggccaggcagggcgcctgggagaacccctacactgccctggcctttgcagagtatgcccgactgtgctttcaagagctcggccatcacgtcaagctttggataacgatgaatgagccgtatacaaggaatatgacatacagtgctggccacaaccttctgaaggcccatgccctggcttggcatgtgtacaatgaaaagtttaggcatgctcagaatgggaaaatatccatagccttgcaggctgattggatagaacctgcctgccctttctcccaaaaggacaaagaggtggctgagagagttttggaatttgacattggctggctggctgagcccattttcggctctggagattatccatgggtgatgagggactggctgaaccaaagaaacaattttcttcttccttatttcactgaagatgaaaaaaagctaatccagggtacctttgactttttggctttaagccattataccaccatccttgtagactcagaaaaagaagatccaataaaatacaatgattacctagaagtgcaagaaatgaccgacatcacgtggctcaactcccccagtcaggtggcggtagtgccctgggggttgcgcaaagtgctgaactggctgaagttcaagtacggagacctccccatgtacataatatccaatggaatcgatgacgggctgcatgctgaggacgaccagctgagggtgtattatatgcagaattacataaacgaagctctcaaagcccacatactggatggtatcaatctttgcggatactttgcttattcgtttaacgaccgcacagctccgaggtttggcctctatcgttatgctgcagatcagtttgagcccaaggcatccatgaaacattacaggaaaattattgacagcaatggtttcccgggcccagaaactctggaaagattttgtccagaagaattcaccgtgtgtactgagtgcagtttttttcacacccgaaagtctttactggctttcatagcttttctattttttgcttctattatttctctctcccttatattttactactcgaagaaaggcagaagaagttacaaatagttctgaacatttttctattcattcattttgaaataattatgcagacacatcagctgttaaccatttgcacctctaagtgttgtgaaactgtaaatttcatacatttgacttctagaaaacatttttgtggcttatgacagaggttttgaaatgggcataggtgatcgtaaaatattgaataatgcgaatagtgcctgaatttgttctctttttgggtgattaaaaaactgacaggcactataatttctgtaacacactaacaaaagcatgaaaaataggaaccacaccaatgcaacatttgtgcagaaatttgaatgacaagattaggaatattttcttctgcacccacttctaaatttaatgtttttctggaagtagtaattgcaagagttcgaatagaaagttatgtaccaagtaaccatttctcagctgccataataatgcctagtggcttcccctctgtcaaatctagtttcctatggaaaagaagatggcagatacaggagagacgacagagggtcctaggctggaatgttcctttcgaaagcaatgcttctatcaaatactagtattaatttatgtatctggttaatgacatacttggagagcaaattatggaaatgtgtattttatatgatttttgaggtcctgtctaaaccctgtgtccctgagggatctgtctcactggcatcttgttgagggccttgcacataggaaacttttgataagtatctgcggaaaaacaaacatgaatcctgtgatattgggctcttcaggaagcataaagcaattgtgaaatacagtataccgcagtggctctaggtggaggaaaggaggaaaaagtgcttattatgtgcaacattatgattaatctgattatacaccatttttgagcagatcttggaatgaatgacatgacctttccctagagaataaggatgaaataatcactcattctatgaacagtgacactactttctattctttagctgtactgtaatttctttgagttgatagttttacaaattcttaataggttcaaaagcaatctggtctgaataacactggatttgtttctgtgatctctgaggtctattttatgtttttgctgctacttctgtggaagtagctttgaactagttttactttgaactttcacgctgaaacatgctagtgatatctagaaagggctaattaggtctcatcctttaatgccccttaaataagtcttgctgattttcagacagggaagtctctctattacactggagctgttttatagataagtcaatattgtatcaggcaagataaaccaatgtcataacaggcattgccaacctcactgacacagggtcatagtgtataataatatactgtactatataatatatcatctttagaggtatgattttttcatgaaagataagcttttggtaatattcattttaaagtggacttattaaaattggatgctagagaatcaagtttattttatgtatatatttttctgattataagagtaatatatgttcattgtaaaaatttttaaaacacagaaactatatgcaaagaaaaaataaaaattatctataatctcagaacccagaaatagccactattaacatttcctacgtattttattttacatagatcatattgtatatagttagtatctttattaatttttattatgaaactttcctttgtcattattagtcttcaaaagcatgatttttaatagttgttgagtattccaccacaggaatgtatcacaacttaaccgttcccgtttgttagactagtttcttattaatgttgatgaatgttgtttaaaaataattttgttgctacatttactttaatttccttgactgtaaagagaagtaattttgctccttgataaagtattatattaataataaatctgcctgcaactttttgccttctttcataatcataaaaaaa

SEQ ID NO: 79 - protein, 1012 aa, Artificial Sequence
  KL
MPASAPPRRPRPPPPSLSLLLVLLGLGGRRLRAEPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSLLAFIAFLFFASIISLSLIFYYSKKGRRSYK

SEQ ID NO: 80 - DNA, 5878 bp, Artificial Sequence
  RBPJ
attgggtacatgcgcagtgccgctcgcgcgggccgcgccaatcctgcagcgccttcaacaggtttcgggcggcgaattccagttctccgggttttggggctccctgcgggaggcagtgctggatctgggaatctctaggaaaggaaagagcaaaggaggggaaagatggggggctgcagtctccacgtacgtccctcaaagcgcgtcctaaaacccggataaccggagcgctccccatggaccacacggagggctcgcccgcggaggagccgcctgcgcatgctccatcgcctgggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacatgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgttttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccattgtaaaagtcttctgtcgaatgtgcctgatgcatgtattatcgtcttttatttcagaatacttcataaagataaaattaaattctatattatagttggtgtatttacaatcttaccatgtacatcacatcaaagtgatagctctactaatttaatttccttgtcaatgtttttaactatatagtgctttaaagagattttttttccctgtgtaaaaaaaaaaaaaaaaaa

SEQ ID NO: 81 - DNA, 5825 bp, Artificial Sequence
  RBPJ
atcgcctgggtaggtttccagggaaggcagcgagcaggatcccctactctgcgggcggcgcgaggcgtctggctcttcgcggcggcggcgaggggaaagggagcgcgggggctgggtggaatcgaggagtgaggaaaaagggaaggggcgggggagagggaccagggaaggcgtcggggggaatctcgcgagggttggagttttggcgagagtttgtggaagatggcgcctgttgtgacagggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacatgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgttttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccattgtaaaagtcttctgtcgaatgtgcctgatgcatgtattatcgtcttttatttcagaatacttcataaagataaaattaaattctatattatagttggtgtatttacaatcttaccatgtacatcacatcaaagtgatagctctactaatttaatttccttgtcaatgtttttaactatatagtgctttaaagagattttttttccctgtgtaaaaaaaaaaaaaaaaaa

SEQ ID NO: 82 - DNA, 5762 bp, Artificial Sequence
  RBPJ
attgggtacatgcgcagtgccgctcgcgcgggccgcgccaatcctgcagcgccttcaacaggtttcgggcggcgaattccagttctccgggttttggggctccctgcgggaggcagtgctggatctgggaatctctaggaaaggaaagagcaaaggaggggaaagatggggggctgcaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacatgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgttttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccattgtaaaagtcttctgtcgaatgtgcctgatgcatgtattatcgtcttttatttcagaatacttcataaagataaaattaaattctatattatagttggtgtatttacaatcttaccatgtacatcacatcaaagtgatagctctactaatttaatttccttgtcaatgtttttaactatatagtgctttaaagagattttttttccctgtgtaaaaaaaaaaaaaaaaaa

SEQ ID NO: 83 - DNA, 6008 bp, Artificial Sequence
  RBPJ
atcgcctgggtaggtttccagggaaggcagcgagcaggatcccctactctgcgggcggcgcgaggcgtctggctcttcgcggcggcggcgaggggaaagggagcgcgggggctgggtggaatcgaggagtgaggaaaaagggaaggggcgggggagagggaccagggaaggcgtcggggggaatctcgcgagggttggagttttggcgagagtttgtggaagatggcgcctgttgtgacaggtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacatgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgttttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccattgtaaaagtcttctgtcgaatgtgcctgatgcatgtattatcgtcttttatttcagaatacttcataaagataaaattaaattctatattatagttggtgtatttacaatcttaccatgtacatcacatcaaagtgatagctctactaatttaatttccttgtcaatgtttttaactatatagtgctttaaagagattttttttccctgtgtaaaaaaaaaaaaaaaaaa

SEQ ID NO: 84 - protein, 500 aa, Artificial Sequence
  RBPJ
MDHTEGSPAEEPPAHAPSPGKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 85 - protein, 487 aa, Artificial Sequence
  RBPJ
MAPVVTGKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 86 - protein, 485 aa, Artificial Sequence
  RBPJ
MGGCRKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 87 - protein, 486 aa, Artificial Sequence
  RBPJ
MAWIKRKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 88 - DNA, 3963 bp, Artificial Sequence
  Sox9
ggagagccgaaagcggagctcgaaactgactggaaacttcagtggcgcggagactcgccagtttcaaccccggaaacttttctttgcaggaggagaagagaaggggtgcaagcgcccccacttttgctctttttcctcccctcctcctcctctccaattcgcctccccccacttggagcgggcagctgtgaactggccaccccgcgccttcctaagtgctcgccgcggtagccggccgacgcgccagcttccccgggagccgcttgctccgcatccgggcagccgaggggagaggagcccgcgcctcgagtccccgagccgccgcggcttctcgcctttcccggccaccagccccctgccccgggcccgcgtatgaatctcctggaccccttcatgaagatgaccgacgagcaggagaagggcctgtccggcgcccccagccccaccatgtccgaggactccgcgggctcgccctgcccgtcgggctccggctcggacaccgagaacacgcggccccaggagaacacgttccccaagggcgagcccgatctgaagaaggagagcgaggaggacaagttccccgtgtgcatccgcgaggcggtcagccaggtgctcaaaggctacgactggacgctggtgcccatgccggtgcgcgtcaacggctccagcaagaacaagccgcacgtcaagcggcccatgaacgccttcatggtgtgggcgcaggcggcgcgcaggaagctcgcggaccagtacccgcacttgcacaacgccgagctcagcaagacgctgggcaagctctggagacttctgaacgagagcgagaagcggcccttcgtggaggaggcggagcggctgcgcgtgcagcacaagaaggaccacccggattacaagtaccagccgcggcggaggaagtcggtgaagaacgggcaggcggaggcagaggaggccacggagcagacgcacatctcccccaacgccatcttcaaggcgctgcaggccgactcgccacactcctcctccggcatgagcgaggtgcactcccccggcgagcactcggggcaatcccagggcccaccgaccccacccaccacccccaaaaccgacgtgcagccgggcaaggctgacctgaagcgagaggggcgccccttgccagaggggggcagacagccccctatcgacttccgcgacgtggacatcggcgagctgagcagcgacgtcatctccaacatcgagaccttcgatgtcaacgagtttgaccagtacctgccgcccaacggccacccgggggtgccggccacgcacggccaggtcacctacacgggcagctacggcatcagcagcaccgcggccaccccggcgagcgcgggccacgtgtggatgtccaagcagcaggcgccgccgccacccccgcagcagcccccacaggccccgccggccccgcaggcgcccccgcagccgcaggcggcgcccccacagcagccggcggcacccccgcagcagccacaggcgcacacgctgaccacgctgagcagcgagccgggccagtcccagcgaacgcacatcaagacggagcagctgagccccagccactacagcgagcagcagcagcactcgccccaacagatcgcctacagccccttcaacctcccacactacagcccctcctacccgcccatcacccgctcacagtacgactacaccgaccaccagaactccagctcctactacagccacgcggcaggccagggcaccggcctctactccaccttcacctacatgaaccccgctcagcgccccatgtacacccccatcgccgacacctctggggtcccttccatcccgcagacccacagcccccagcactgggaacaacccgtctacacacagctcactcgaccttgaggaggcctcccacgaagggcgaagatggccgagatgatcctaaaaataaccgaagaaagagaggaccaaccagaattccctttggacatttgtgtttttttgtttttttattttgttttgttttttcttcttcttcttcttccttaaagacatttaagctaaaggcaactcgtacccaaatttccaagacacaaacatgacctatccaagcgcattacccacttgtggccaatcagtggccaggccaaccttggctaaatggagcagcgaaatcaacgagaaactggactttttaaaccctcttcagagcaagcgtggaggatgatggagaatcgtgtgatcagtgtgctaaatctctctgcctgtttggactttgtaattatttttttagcagtaattaaagaaaaaagtcctctgtgaggaatattctctattttaaatatttttagtatgtactgtgtatgattcattaccattttgaggggatttatacatatttttagataaaattaaatgctcttatttttccaacagctaaactactcttagttgaacagtgtgccctagcttttcttgcaaccagagtatttttgtacagatttgctttctcttacaaaaagaaaaaaaaaatcctgttgtattaacatttaaaaacagaattgtgttatgtgatcagttttgggggttaactttgcttaattcctcaggctttgcgatttaaggaggagctgccttaaaaaaaaataaaggccttattttgcaattatgggagtaaacaatagtctagagaagcatttggtaagctttatcatatatatattttttaaagaagagaaaaacaccttgagccttaaaacggtgctgctgggaaacatttgcactcttttagtgcatttcctcctgcctttgcttgttcactgcagtcttaagaaagaggtaaaaggcaagcaaaggagatgaaatctgttctgggaatgtttcagcagccaataagtgcccgagcacactgcccccggttgcctgcctgggccccatgtggaaggcagatgcctgctcgctctgtcacctgtgcctctcagaacaccagcagttaaccttcaagacattccacttgctaaaattatttattttgtaaggagaggttttaattaaaacaaaaaaaaattcttttttttttttttttccaattttaccttctttaaaataggttgttggagctttcctcaaagggtatggtcatctgttgttaaattatgttcttaactgtaaccagtttttttttatttatctctttaatctttttttattattaaaagcaagtttctttgtattcctcaccctagatttgtataaatgcctttttgtccatcccttttttctttgttgtttttgttgaaaacaaactggaaacttgtttctttttttgtataaatgagagattgcaaatgtagtgtatcactgagtcatttgcagtgttttctgccacagacctttgggctgccttatattgtgtgtgtgtgtgggtgtgtgtgtgttttgacacaaaaacaatgcaagcatgtgtcatccatatttctctgcatcttctcttggagtgagggaggctacctggaggggatcagcccactgacagaccttaatcttaattactgctgtggctagagagtttgaggattgctttttaaaaaagacagcaaacttttttttttatttaaaaaaagatatattaacagttttagaagtcagtagaataaaatcttaaagcactcataatatggcatccttcaatttctgtataaaagcagatctttttaaaaagatacttctgtaacttaagaaacctggcatttaaatcatattttgtctttaggtaaaagctttggtttgtgttcgtgttttgtttgtttcacttgtttccctcccagccccaaaccttttgttctctccgtgaaacttacctttccctttttctttctcttttttttttttgtatattattgtttacaataaatatacattgcattaaaaagaaaaaaaaaaaaaaaaaaaaaaaaaaaaaaa

SEQ ID NO: 89 - protein, 509 aa, Artificial Sequence
  Sox9
MNLLDPFMKMTDEQEKGLSGAPSPTMSEDSAGSPCPSGSGSDTENTRPQENTFPKGEPDLKKESEEDKFPVCIREAVSQVLKGYDWTLVPMPVRVNGSSKNKPHVKRPMNAFMVWAQAARRKLADQYPHLHNAELSKTLGKLWRLLNESEKRPFVEEAERLRVQHKKDHPDYKYQPRRRKSVKNGQAEAEEATEQTHISPNAIFKALQADSPHSSSGMSEVHSPGEHSGQSQGPPTPPTTPKTDVQPGKADLKREGRPLPEGGRQPPIDFRDVDIGELSSDVISNIETFDVNEFDQYLPPNGHPGVPATHGQVTYTGSYGISSTAATPASAGHVWMSKQQAPPPPPQQPPQAPPAPQAPPQPQAAPPQQPAAPPQQPQAHTLTTLSSEPGQSQRTHIKTEQLSPSHYSEQQQHSPQQIAYSPFNLPHYSPSYPPITRSQYDYTDHQNSSSYYSHAAGQGTGLYSTFTYMNPAQRPMYTPIADTSGVPSIPQTHSPQHWEQPVYTQLTRP

SEQ ID NO: 90 - DNA, 3002 bp, Artificial Sequence
  NeuroD
ggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaagccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataa

SEQ ID NO: 91 - protein, 356 aa, Artificial Sequence
  NeuroD
MTKSYSESGLMGEPQPQGPPSWTDECLSSQDEEHEADKKEDDLEAMNAEEDSLRNGGEEEDEDEDLEEEEEEEEEDDDQKPKRRGPKKKKMTKARLERFKLRRMKANARERNRMHGLNAALDNLRKVVPCYSKTQKLSKIETLRLAKNYIWALSEILRSGKSPDLVSFVQTLCKGLSQPTTNLVAGCLQLNPRTFLPEQNQDMPPHLPTASASFPVHPYSYQSPGLPSPPYGTMDSSHVFHVKPPPHAYSAALEPFFESPLTDCTSPSFDGPLSPPLSINGNFSFKHEPSAEFEKNYAFTMHYPAATLAGAQSHGSIFSGTAAPRCEIPIDNIMSFDSHSHHERVMSAQLNAIFHD

SEQ ID NO: 92 - DNA, 2729 bp, Artificial Sequence
  ISL1
gaaggaagaggaagaggaggagagggaggccagagccagaacagcccggcagcccgagcttcgggggagaacggcctgagccccgagcaagttgcctcgggagccctaatcctctcccgctggctcgccgagcggtcagtggcgctcagcggcggcgaggctgaaatatgataatcagaacagctgcgccgcgcgccctgcagccaatgggcgcggcgctcgcctgacgtccccgcgcgctgcgtcagaccaatggcgatggagctgagttggagcagagaagtttgagtaagagataaggaagagaggtgcccgagccgcgccgagtctgccgccgccgcagcgcctccgctccgccaactccgccggcttaaattggactcctagatccgcgagggcgcggcgcagccgagcagcggctctttcagcattggcaaccccaggggccaatatttcccacttagccacagctccagcatcctctctgtgggctgttcaccaactgtacaaccaccatttcactgtggacattactccctcttacagatatgggagacatgggagatccaccaaaaaaaaaacgtctgatttccctatgtgttggttgcggcaatcagattcacgatcagtatattctgagggtttctccggatttggaatggcatgcggcatgtttgaaatgtgcggagtgtaatcagtatttggacgagagctgtacatgctttgttagggatgggaaaacctactgtaaaagagattatatcaggttgtacgggatcaaatgcgccaagtgcagcatcggcttcagcaagaacgacttcgtgatgcgtgcccgctccaaggtgtatcacatcgagtgtttccgctgtgtggcctgcagccgccagctcatccctggggacgaatttgcgcttcgggaggacggtctcttctgccgagcagaccacgatgtggtggagagggccagtctaggcgctggcgacccgctcagtcccctgcatccagcgcggccactgcaaatggcagcggagcccatctccgccaggcagccagccctgcggccccacgtccacaagcagccggagaagaccacccgcgtgcggactgtgctgaacgagaagcagctgcacaccttgcggacctgctacgccgcaaacccgcggccagatgcgctcatgaaggagcaactggtagagatgacgggcctcagtccccgtgtgatccgggtctggtttcaaaacaagcggtgcaaggacaagaagcgaagcatcatgatgaagcaactccagcagcagcagcccaatgacaaaactaatatccaggggatgacaggaactcccatggtggctgccagtccagagagacacgacggtggcttacaggctaacccagtggaagtacaaagttaccagccaccttggaaagtactgagcgacttcgccttgcagagtgacatagatcagcctgcttttcagcaactggtcaatttttcagaaggaggaccgggctctaattccactggcagtgaagtagcatcaatgtcctctcaacttccagatacacctaacagcatggtagccagtcctattgaggcatgaggaacattcattctgtattttttttccctgttggagaaagtgggaaattataatgtcgaactctgaaacaaaagtatttaacgacccagtcaatgaaaactgaatcaagaaatgaatgctccatgaaatgcacgaagtctgttttaatgacaaggtgatatggtagcaacactgtgaagacaatcatgggattttactagaattaaacaacaaacaaaacgcaaaacccagtatatgctattcaatgatcttagaagtactgaaaaaaaaagacgtttttaaaacgtagaggatttatattcaaggatctcaaagaaagcattttcatttcactgcacatctagagaaaaacaaaaatagaaaattttctagtccatcctaatctgaatggtgctgtttctatattggtcattgccttgccaaacaggagctccagcaaaagcgcaggaagagagactggcctccttggctgaaagagtcctttcaggaaggtggagctgcattggtttgatatgtttaaagttgactttaacaaggggttaattgaaatcctgggtctcttggcctgtcctgtagctggtttattttttactttgccccctccccactttttttgagatccatcctttatcaagaagtctgaagcgactataaaggtttttgaattcagatttaaaaaccaacttataaagcattgcaacaaggttacctctattttgccacaagcgtctcgggattgtgtttgacttgtgtctgtccaagaacttttcccccaaagatgtgtatagttattggttaaaatgactgttttctctctctatggaaataaaaaggaaaaaaaaaaaggaaactttttttgtttgctcttgcattgcaaaaattataaagtaatttattatttattgtcggaagacttgccacttttcatgtcatttgacattttttgtttgctgaagtgaaaaaaaaagataaaggttgtacggtggtctttgaattatatgtctaattctatgtgttttgtctttttcttaaatattatgtgaaatcaaagcgccatatgtagaattatatcttcaggactatttcactaataaacatttggcatagataaataaataaaaaaaaaaaaaa

SEQ ID NO: 93 - protein, 349 aa, Artificial Sequence
  ISL1
MGDMGDPPKKKRLISLCVGCGNQIHDQYILRVSPDLEWHAACLKCAECNQYLDESCTCFVRDGKTYCKRDYIRLYGIKCAKCSIGFSKNDFVMRARSKVYHIECFRCVACSRQLIPGDEFALREDGLFCRADHDVVERASLGAGDPLSPLHPARPLQMAAEPISARQPALRPHVHKQPEKTTRVRTVLNEKQLHTLRTCYAANPRPDALMKEQLVEMTGLSPRVIRVWFQNKRCKDKKRSIMMKQLQQQQPNDKTNIQGMTGTPMVAASPERHDGGLQANPVEVQSYQPPWKVLSDFALQSDIDQPAFQQLVNFSEGGPGSNSTGSEVASMSSQLPDTPNSMVASPIEA

SEQ ID NO: 94 - DNA, 1375 bp, Artificial Sequence
  RGS2
gcaaacagccggggctccagcgggagaacgataatgcaaagtgctatgttcttggctgttcaacacgactgcagacccatggacaagagcgcaggcagtggccacaagagcgaggagaagcgagaaaagatgaaacggacccttttaaaagattggaagacccgtttgagctacttcttacaaaattcctctactcctgggaagcccaaaaccggcaaaaaaagcaaacagcaagctttcatcaagccttctcctgaggaagcacagctgtggtcagaagcatttgacgagctgctagccagcaaatatggtcttgctgcattcagggcttttttaaagtcggaattctgtgaagaaaatattgaattctggctggcctgtgaagacttcaaaaaaaccaaatcaccccaaaagctgtcctcaaaagcaaggaaaatatatactgacttcatagaaaaggaagctccaaaagagataaacatagattttcaaaccaaaactctgattgcccagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccataaagactgaccttgaattcagcctgggtgttcaggaaacatcactcagaactattgattcaaagttgggtagtgaatcaggaagccagtaactgactaggagaagctggtatcagaacagcttccctcactgtgtacagaacgcaagaagggaataggtggtctgaacgtggtgtctcactctgaaaagcaggaatgtaagatgatgaaagagacaatgtaatactgttggtccaaaagcatttaaaatcaatagatctgggattatgtggccttaggtagctggttgtacatctttccctaaatcgatccatgttaccacatagtagttttagtttaggattcagtaacagtgaagtgtttactatgtgcaacggtattgaagttcttatgaccacagatcatcagtactgttgtctcatgtaatgctaaaactgaaatggtccgtgtttgcattgttaaaaatgatgtgtgaaatagaatgagtgctatggtgttgaaaactgcagtgtccgttatgagtgccaaaaatctgtcttgaaggcagctacactttgaagtggtctttgaatacttttaataaatttattttgataaataatattgaacaaaaaaaaaaaaaaaaaaaaaaaaaa

SEQ ID NO: 95 - protein, 211 aa, Artificial Sequence
  RGS2
MQSAMFLAVQHDCRPMDKSAGSGHKSEEKREKMKRTLLKDWKTRLSYFLQNSSTPGKPKTGKKSKQQAFIKPSPEEAQLWSEAFDELLASKYGLAAFRAFLKSEFCEENIEFWLACEDFKKTKSPQKLSSKARKIYTDFIEKEAPKEINIDFQTKTLIAQNIQEATSGCFTTAQKRVYSLMENNSYPRFLESEFYQDLCKKPQITTEPHAT

SEQ ID NO: 96 - DNA, 1718 bp, Artificial Sequence
  IL8
gagggtgcataagttctctagtagggtgatgatataaaaagccaccggagcactccataaggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgaggccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaaaaaaaaaaaaaaa

SEQ ID NO: 97 - protein, 99 aa, Artificial Sequence
  IL8
MTSKLAVALLAAFLISAALCEGAVLPRSAKELRCQCIKTYSKPFHPKFIKELRVIESGPHCANTEIIVKLSDGRELCLDPKENWVQRVVEKFLKRAENS

SEQ ID NO: 98 - DNA, 2473 bp, Artificial Sequence
  AKAP7
aattactgcagttgtctgtaggagaaagggctcattgtggtttttctcgactacctttcttaaagacatatgcaaatagccagacagaacacatggcactgacctatggccagggactcacagttttgtgagaatacgggagcgtatagccacttccttcactgaatgccagtcccagagcagttgcattaggctggaggactggaggtggagccttttttgctcacggcagcaagttcccttctcctttctctcccccggcggcgtgtgcattggctcttcaagctgcctgtgctgctccgtggagtgaaaaaggcagggtgtgctcgcagactgtgctataaactgcaatttctatttggggtcctcacggagaagaacaccaggaaagacagacaggaccagtgccatgggccagctttgctgctttcctttctcaagagatgaaggaaaaatcagtgaaaagaacggaggggagcccgatgacgctgaactagtaaggctcagtaagaggctggtggagaacgcggtgctcaaggctgtccagcagtatctggaggaaacacagaataaaaacaagccgggggaggggagctctgtgaaaaccgaagcagctgatcagaatggcaatgacaatgagaacaacaggaaatgagcccggaacgcaggcccccatgtctctgtgcaaagcctccctgcttccctctgctgagtctagggactgacttgcagcgtgctgtttaagttaagtttctctggtgcaatctgtgaagattgcctaatacttttcatgatcgatgtgttcgcattgctgaaacacaacagaagaaaaatggagtgctgggactggcagaggaaattaattgatgaaagaagaatggcccaagtttcattcgccctcagccacgcacaagggaaagggaactttgggttatgcctcctggacgcaaattaaaggccgagaaagaggccttgccatcaatggaatactgccatttatattgcttagcagggcatttgactactttatctgaggccagaactctcacacacagctatcaagtgctaagtttaaaataatcactgttggaattgtcatctgtacaattagtccataatgtttcatgtttgtcctaagtgtgctgttgctatgcagtgtgatctttatttatagtaaattatgtttcatgtaaatgatatatttttggtgaaatgcaaccttttctataaaatgtgggcaacattttaaagtttttttaaaatcctattttgataagtcagtatgccatatttaatgaaatgttattatataatttttttttcttaggcaagaaacctattggaattcgagacttaattaatgaagctttgcatcgagaaacgatgggtctgaagtccaaagtgaaacagataaaggaacttttattaaagcctgagactcaggccagaattaggagggagctttttgaaggaagacttattaacaacagtaattcagcaaatgacgttgatttcagcacaactttgacataagctctacattgcgattgtgacaacatagcttatgaaatcttttcagcttattaagtagctctttggtaaacaccaaagaagtttctgatagtgtctgcacaacagcaaaccaacatttggtgaggaattagcaatttcttgccaaagaaaattgattctgcccaattattttttgagctacacttgtgttttagaatatctgtttctgtaatattgagagttattttatagaaatgatttcttaattagctgttgtgagatatttctcgggtccttgcagaaaaaaacatacagactgtgaacaaatcattcacaaacagaataaaacagagccaacaacagtattttaagggtcacttgcctcctgttgacacaattgttgctaaatcaaaagaagcgttgtccaggtgtgtctacatctagtgttacttttaatgagaatttgaatgtttattgaacaatagtacttgaatgaacatttataaatgtaattattgcgatcactggttaagaatgttttatatatccttataatatttttcactgatcaaaatgttgttctgctttttcatttcttaaggaatacatgtttgggatttttattttttacgtgtccgaagataagctccaggtcttatcgtatcccttgccatctgaacttgtttgcactgcttctgtttgaaagagcatcttgaaaaacttccccggtatgatgattgttggtaacaactttttctatagtcattgatggagtagatcatgatggaggggaaatcactggagatcaaatatgtaaaatcatttcaaatataaaatccagtttactcatggattttagctattttttcactgggtaaattatactacatttatttacaaatgagtttatgcattttcatggctcttaataaacatattgttttcccttgttaaaaaaaaa

SEQ ID NO: 99 - DNA, 2943 bp, Artificial Sequence
  AKAP7
ctcgcctccagccccgggacgcggcccgccaccgccgctgccgccagcccagacgcgccgcccgcatgcgccgcgaccatggagcgccccgaagcgggaggaattaattccaatgagtgtgaaaatgtatcaagaaaaaagaaaatgtcagaggaatttgaagccaatactatggattctctggtagacatgccatttgctactgtagatattcaggatgactgtggaatcactgatgaacctcaaataaatttgaagagaagtcaagaaaatgaatgggtcaagagtgatcaagtaaagaagaggaaaaaaaagagaaaagattatcaacccaactatttcctgtccattccaatcaccaacaaagagattataaaaggaattaagatcctgcagaatgcaataatacaacaagatgagcgactggccaaagcaatggtcagtgatggttcctttcatattaccctgctggtgatgcaattattaaatgaagatgaagtaaacattggtattgatgctcttttggaattgaaaccattcatagaagaactcctccagggaaaacatttgactttgccctttcaagggattggtacttttggaaatcaggttggatttgtgaagctggcagaaggagatcatgtaaactcacttttggagatagcagagactgcaaataggacatttcaagaaaaaggcatcctggtaggagagagcagaagttttaaacctcatttgaccttcatgaagttgtcaaaatcaccgtggctccgtaagaatggagtgaaaaaaatagatcctgatttatatgaaaagtttatcagtcacagatttggagaagaaatattatatcgcatagatctttgctccatgctgaagaaaaaacaaagtaatggttattatcactgtgaatcttccattgtgattggtgaaaagaacggaggggagcccgatgacgctgaactagtaaggctcagtaagaggctggtggagaacgcggtgctcaaggctgtccagcagtatctggaggaaacacagaataaaaacaagccgggggaggggagctctgtgaaaaccgaagcagctgatcagaatggcaatgacaatgagaacaacaggaaatgagcccggaacgcaggcccccatgtctctgtgcaaagcctccctgcttccctctgctgagtctagggactgacttgcagcgtgctgtttaagttaagtttctctggtgcaatctgtgaagattgcctaatacttttcatgatcgatgtgttcgcattgctgaaacacaacagaagaaaaatggagtgctgggactggcagaggaaattaattgatgaaagaagaatggcccaagtttcattcgccctcagccacgcacaagggaaagggaactttgggttatgcctcctggacgcaaattaaaggccgagaaagaggccttgccatcaatggaatactgccatttatattgcttagcagggcatttgactactttatctgaggccagaactctcacacacagctatcaagtgctaagtttaaaataatcactgttggaattgtcatctgtacaattagtccataatgtttcatgtttgtcctaagtgtgctgttgctatgcagtgtgatctttatttatagtaaattatgtttcatgtaaatgatatatttttggtgaaatgcaaccttttctataaaatgtgggcaacattttaaagtttttttaaaatcctattttgataagtcagtatgccatatttaatgaaatgttattatataatttttttttcttaggcaagaaacctattggaattcgagacttaattaatgaagctttgcatcgagaaacgatgggtctgaagtccaaagtgaaacagataaaggaacttttattaaagcctgagactcaggccagaattaggagggagctttttgaaggaagacttattaacaacagtaattcagcaaatgacgttgatttcagcacaactttgacataagctctacattgcgattgtgacaacatagcttatgaaatcttttcagcttattaagtagctctttggtaaacaccaaagaagtttctgatagtgtctgcacaacagcaaaccaacatttggtgaggaattagcaatttcttgccaaagaaaattgattctgcccaattattttttgagctacacttgtgttttagaatatctgtttctgtaatattgagagttattttatagaaatgatttcttaattagctgttgtgagatatttctcgggtccttgcagaaaaaaacatacagactgtgaacaaatcattcacaaacagaataaaacagagccaacaacagtattttaagggtcacttgcctcctgttgacacaattgttgctaaatcaaaagaagcgttgtccaggtgtgtctacatctagtgttacttttaatgagaatttgaatgtttattgaacaatagtacttgaatgaacatttataaatgtaattattgcgatcactggttaagaatgttttatatatccttataatatttttcactgatcaaaatgttgttctgctttttcatttcttaaggaatacatgtttgggatttttattttttacgtgtccgaagataagctccaggtcttatcgtatcccttgccatctgaacttgtttgcactgcttctgtttgaaagagcatcttgaaaaacttccccggtatgatgattgttggtaacaactttttctatagtcattgatggagtagatcatgatggaggggaaatcactggagatcaaatatgtaaaatcatttcaaatataaaatccagtttactcatggattttagctattttttcactgggtaaattatactacatttatttacaaatgagtttatgcattttcatggctcttaataaacatattgttttcccttgttaaaaaaaaa

SEQ ID NO: 100 - DNA, 2542 bp, Artificial Sequence
  AKAP7
aattactgcagttgtctgtaggagaaagggctcattgtggtttttctcgactacctttcttaaagacatatgcaaatagccagacagaacacatggcactgacctatggccagggactcacagttttgtgagaatacgggagcgtatagccacttccttcactgaatgccagtcccagagcagttgcattaggctggaggactggaggtggagccttttttgctcacggcagcaagttcccttctcctttctctcccccggcggcgtgtgcattggctcttcaagctgcctgtgctgctccgtggagtgaaaaaggcagggtgtgctcgcagactgtgctataaactgcaatttctatttggggtcctcacggagaagaacaccaggaaagacagacaggaccagtgccatgggccagctttgctgctttcctttctcaagagatgaaggaaaaatcagtgagttggaaagctcgtcctctgcagtcctacagagatacagcaaggatatacccagttggtcaagtggtgaaaagaacggaggggagcccgatgacgctgaactagtaaggctcagtaagaggctggtggagaacgcggtgctcaaggctgtccagcagtatctggaggaaacacagaataaaaacaagccgggggaggggagctctgtgaaaaccgaagcagctgatcagaatggcaatgacaatgagaacaacaggaaatgagcccggaacgcaggcccccatgtctctgtgcaaagcctccctgcttccctctgctgagtctagggactgacttgcagcgtgctgtttaagttaagtttctctggtgcaatctgtgaagattgcctaatacttttcatgatcgatgtgttcgcattgctgaaacacaacagaagaaaaatggagtgctgggactggcagaggaaattaattgatgaaagaagaatggcccaagtttcattcgccctcagccacgcacaagggaaagggaactttgggttatgcctcctggacgcaaattaaaggccgagaaagaggccttgccatcaatggaatactgccatttatattgcttagcagggcatttgactactttatctgaggccagaactctcacacacagctatcaagtgctaagtttaaaataatcactgttggaattgtcatctgtacaattagtccataatgtttcatgtttgtcctaagtgtgctgttgctatgcagtgtgatctttatttatagtaaattatgtttcatgtaaatgatatatttttggtgaaatgcaaccttttctataaaatgtgggcaacattttaaagtttttttaaaatcctattttgataagtcagtatgccatatttaatgaaatgttattatataatttttttttcttaggcaagaaacctattggaattcgagacttaattaatgaagctttgcatcgagaaacgatgggtctgaagtccaaagtgaaacagataaaggaacttttattaaagcctgagactcaggccagaattaggagggagctttttgaaggaagacttattaacaacagtaattcagcaaatgacgttgatttcagcacaactttgacataagctctacattgcgattgtgacaacatagcttatgaaatcttttcagcttattaagtagctctttggtaaacaccaaagaagtttctgatagtgtctgcacaacagcaaaccaacatttggtgaggaattagcaatttcttgccaaagaaaattgattctgcccaattattttttgagctacacttgtgttttagaatatctgtttctgtaatattgagagttattttatagaaatgatttcttaattagctgttgtgagatatttctcgggtccttgcagaaaaaaacatacagactgtgaacaaatcattcacaaacagaataaaacagagccaacaacagtattttaagggtcacttgcctcctgttgacacaattgttgctaaatcaaaagaagcgttgtccaggtgtgtctacatctagtgttacttttaatgagaatttgaatgtttattgaacaatagtacttgaatgaacatttataaatgtaattattgcgatcactggttaagaatgttttatatatccttataatatttttcactgatcaaaatgttgttctgctttttcatttcttaaggaatacatgtttgggatttttattttttacgtgtccgaagataagctccaggtcttatcgtatcccttgccatctgaacttgtttgcactgcttctgtttgaaagagcatcttgaaaaacttccccggtatgatgattgttggtaacaactttttctatagtcattgatggagtagatcatgatggaggggaaatcactggagatcaaatatgtaaaatcatttcaaatataaaatccagtttactcatggattttagctattttttcactgggtaaattatactacatttatttacaaatgagtttatgcattttcatggctcttaataaacatattgttttcccttgttaaaaaaaaa

SEQ ID NO: 101 - protein, 81 aa, Artificial Sequence
  AKAP7
MGQLCCFPFSRDEGKISEKNGGEPDDAELVRLSKRLVENAVLKAVQQYLEETQNKNKPGEGSSVKTEAADQNGNDNENNRK

SEQ ID NO: 102 - protein, 348 aa, Artificial Sequence
  AKAP7
MERPEAGGINSNECENVSRKKKMSEEFEANTMDSLVDMPFATVDIQDDCGITDEPQINLKRSQENEWVKSDQVKKRKKKRKDYQPNYFLSIPITNKEIIKGIKILQNAIIQQDERLAKAMVSDGSFHITLLVMQLLNEDEVNIGIDALLELKPFIEELLQGKHLTLPFQGIGTFGNQVGFVKLAEGDHVNSLLEIAETANRTFQEKGILVGESRSFKPHLTFMKLSKSPWLRKNGVKKIDPDLYEKFISHRFGEEILYRIDLCSMLKKKQSNGYYHCESSIVIGEKNGGEPDDAELVRLSKRLVENAVLKAVQQYLEETQNKNKPGEGSSVKTEAADQNGNDNENNRK

SEQ ID NO: 103 - protein, 104 aa, Artificial Sequence
  AKAP7
MGQLCCFPFSRDEGKISELESSSSAVLQRYSKDIPSWSSGEKNGGEPDDAELVRLSKRLVENAVLKAVQQYLEETQNKNKPGEGSSVKTEAADQNGNDNENNRK

SEQ ID NO: 104 - DNA, 2648 bp, Artificial Sequence
  CPE
gcccgtctctccgccggccccctcctcgcagtggtttctcctgcagctcccctgggctccgcggccagtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggcagacaaaagaggccgcccgcgtaggaaggcacggccggcggcggcggagcgcagcgatggccgggcgagggggcagcgcgctgctggctctgtgcggggcactggctgcctgcgggtggctcctgggcgccgaagcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagaccttgtggccaattatccatatgatgagacgcggagtggtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaacggtggtgcttggtacagcgtacctggagggatgcaagacttcaattaccttagcagcaactgttttgagatcaccgtggagcttagctgtgagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaaaaaaaatccccagtgcatgtatttcagttctctaagatttttggtctggcattgtggtcttatgatgaaaacatgtatcctcttaatggcggcttctcatatattcatcctgtacattttaaaatttgttaagcaactactgtgtgctaagcactgcatagcctctatgtatgttattgtggcaggcaaaaggttctgattttgggcacaacctttatataaataacacaaaaattaa

SEQ ID NO: 105 - protein, 476 aa, Artificial Sequence
  CPE
MAGRGGSALLALCGALAACGWLLGAEAQEPGAPAAGMRRRRRLQQEDGISFEYHRYPELREALVSVWLQCTAISRIYTVGRSFEGRELLVIELSDNPGVHEPGEPEFKYIGNMHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGDLVANYPYDETRSGSAHEYSSSPDDAIFQSLARAYSSFNPAMSDPNRPPCRKNDDDSSFVDGTTNGGAWYSVPGGMQDFNYLSSNCFEITVELSCEKFPPEETLKTYWEDNKNSLISYLEQIHRGVKGFVRDLQGNPIANATISVEGIDHDVTSAKDGDYWRLLIPGNYKLTASAPGYLAITKKVAVPYSPAAGVDFELESFSERKEEEKEELMEWWKMMSETLNF

SEQ ID NO: 106 - DNA, 1732 bp, Artificial Sequence
  OAS1
gcatttccagagcagagttcagagaaaggctgggctgcttgttgctggctaaaggacaaagggtaagtttcaggaagcagaagagtgagcagatgaaattcagcactgggatcaggggagtgtctgatttgcaaaaggaaagtgcaaagacagctcctcccttctgaggaaacgaaaccaacagcagtccaagctcagtcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaagggtggctcctcaggcaagggcaccaccctcagaggccgatctgacgctgacctggttgtcttcctcagtcctctcaccacttttcaggatcagttaaatcgccggggagagttcatccaggaaattaggagacagctggaagcctgtcaaagagagagagcattttccgtgaagtttgaggtccaggctccacgctggggcaacccccgtgcgctcagcttcgtactgagttcgctccagctcggggagggggtggagttcgatgtgctgcctgcctttgatgccctgggtcagttgactggcggctataaacctaacccccaaatctatgtcaagctcatcgaggagtgcaccgacctgcagaaagagggcgagttctccacctgcttcacagaactacagagagacttcctgaagcagcgccccaccaagctcaagagcctcatccgcctagtcaagcactggtaccaaaattgtaagaagaagcttgggaagctgccacctcagtatgccctggagctcctgacggtctatgcttgggagcgagggagcatgaaaacacatttcaacacagcccagggatttcggacggtcttggaattagtcataaactaccagcaactctgcatctactggacaaagtattatgactttaaaaaccccattattgaaaagtacctgagaaggcagctcacgaaacccaggcctgtgatcctggacccggcggaccctacaggaaacttgggtggtggagacccaaagggttggaggcagctggcacaagaggctgaggcctggctgaattacccatgctttaagaattgggatgggtccccagtgagctcctggattctgctgacccagcacactccaggcagcatccaccccacaggcagaagaggactggacctgcaccatcctctgaatgccagtgcatcttgggggaaagggctccagtgttatctggaccagttccttcattttcaggtgggactcttgatccagagaggacaaagctcctcagtgagctggtgtataatccaggacagaacccaggtctcctgactcctggccttctatgccctctatcctatcatagataacattctccacagcctcacttcattccacctattctctgaaaatattccctgagagagaacagagagatttagataagagaatgaaattccagccttgactttcttctgtgcacctgatgggagggtaatgtctaatgtattatcaataacaataaaaataaagcaaataccatttaaaaaaaaaaa

SEQ ID NO: 107 - DNA, 1614 bp, Artificial Sequence
  OAS1
gcatttccagagcagagttcagagaaaggctgggctgcttgttgctggctaaaggacaaagggtaagtttcaggaagcagaagagtgagcagatgaaattcagcactgggatcaggggagtgtctgatttgcaaaaggaaagtgcaaagacagctcctcccttctgaggaaacgaaaccaacagcagtccaagctcagtcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaagggtggctcctcaggcaagggcaccaccctcagaggccgatctgacgctgacctggttgtcttcctcagtcctctcaccacttttcaggatcagttaaatcgccggggagagttcatccaggaaattaggagacagctggaagcctgtcaaagagagagagcattttccgtgaagtttgaggtccaggctccacgctggggcaacccccgtgcgctcagcttcgtactgagttcgctccagctcggggagggggtggagttcgatgtgctgcctgcctttgatgccctgggtcagttgactggcggctataaacctaacccccaaatctatgtcaagctcatcgaggagtgcaccgacctgcagaaagagggcgagttctccacctgcttcacagaactacagagagacttcctgaagcagcgccccaccaagctcaagagcctcatccgcctagtcaagcactggtaccaaaattgtaagaagaagcttgggaagctgccacctcagtatgccctggagctcctgacggtctatgcttgggagcgagggagcatgaaaacacatttcaacacagcccagggatttcggacggtcttggaattagtcataaactaccagcaactctgcatctactggacaaagtattatgactttaaaaaccccattattgaaaagtacctgagaaggcagctcacgaaacccaggcctgtgatcctggacccggcggaccctacaggaaacttgggtggtggagacccaaagggttggaggcagctggcacaagaggctgaggcctggctgaattacccatgctttaagaattgggatgggtccccagtgagctcctggattctgctggtaaacctcacactggttggcagaaggaactataccaataattagtgaacatgcggtgaatttgcaacagacaagaggagcctcattatcctatagtttccaggttgcttagggaggcagaaatcacagcaaggaaaaccttcaataataaacagacgtctcataaaattaattgcaacccaacctctctctctacttaaaattagcatctatttccagctctgctttcaatgccccatatgaatacatgtgaactccctccctctcttcctccctgtctccttctctctctctctgtccctcattaaaaaat

SEQ ID NO: 108 - DNA, 1627 bp, Artificial Sequence
  OAS1
gcatttccagagcagagttcagagaaaggctgggctgcttgttgctggctaaaggacaaagggtaagtttcaggaagcagaagagtgagcagatgaaattcagcactgggatcaggggagtgtctgatttgcaaaaggaaagtgcaaagacagctcctcccttctgaggaaacgaaaccaacagcagtccaagctcagtcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaagggtggctcctcaggcaagggcaccaccctcagaggccgatctgacgctgacctggttgtcttcctcagtcctctcaccacttttcaggatcagttaaatcgccggggagagttcatccaggaaattaggagacagctggaagcctgtcaaagagagagagcattttccgtgaagtttgaggtccaggctccacgctggggcaacccccgtgcgctcagcttcgtactgagttcgctccagctcggggagggggtggagttcgatgtgctgcctgcctttgatgccctgggtcagttgactggcggctataaacctaacccccaaatctatgtcaagctcatcgaggagtgcaccgacctgcagaaagagggcgagttctccacctgcttcacagaactacagagagacttcctgaagcagcgccccaccaagctcaagagcctcatccgcctagtcaagcactggtaccaaaattgtaagaagaagcttgggaagctgccacctcagtatgccctggagctcctgacggtctatgcttgggagcgagggagcatgaaaacacatttcaacacagcccagggatttcggacggtcttggaattagtcataaactaccagcaactctgcatctactggacaaagtattatgactttaaaaaccccattattgaaaagtacctgagaaggcagctcacgaaacccaggcctgtgatcctggacccggcggaccctacaggaaacttgggtggtggagacccaaagggttggaggcagctggcacaagaggctgaggcctggctgaattacccatgctttaagaattgggatgggtccccagtgagctcctggattctgctggtgagacctcctgcttcctccctgccattcatccctgcccctctccatgaagcttgagacatatagctggagaccattctttccaaagaacttacctcttgccaaaggccatttatattcatatagtgacaggctgtgctccatattttacagtcattttggtcacaatcgagggtttctggaattttcacatcccttgtccagaattcattcccctaagagtaataataaataatctctaacaccatttattgactgtctgcttcgggctcaggttctgtcctaagccctttaatatgcactctctcattaaatagtcacaacaa

SEQ ID NO: 109 - DNA, 1830 bp, Artificial Sequence
  OAS1
gcatttccagagcagagttcagagaaaggctgggctgcttgttgctggctaaaggacaaagggtaagtttcaggaagcagaagagtgagcagatgaaattcagcactgggatcaggggagtgtctgatttgcaaaaggaaagtgcaaagacagctcctcccttctgaggaaacgaaaccaacagcagtccaagctcagtcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaagggtggctcctcaggcaagggcaccaccctcagaggccgatctgacgctgacctggttgtcttcctcagtcctctcaccacttttcaggatcagttaaatcgccggggagagttcatccaggaaattaggagacagctggaagcctgtcaaagagagagagcattttccgtgaagtttgaggtccaggctccacgctggggcaacccccgtgcgctcagcttcgtactgagttcgctccagctcggggagggggtggagttcgatgtgctgcctgcctttgatgccctgggtcagttgactggcggctataaacctaacccccaaatctatgtcaagctcatcgaggagtgcaccgacctgcagaaagagggcgagttctccacctgcttcacagaactacagagagacttcctgaagcagcgccccaccaagctcaagagcctcatccgcctagtcaagcactggtaccaaaattgtaagaagaagcttgggaagctgccacctcagtatgccctggagctcctgacggtctatgcttgggagcgagggagcatgaaaacacatttcaacacagcccagggatttcggacggtcttggaattagtcataaactaccagcaactctgcatctactggacaaagtattatgactttaaaaaccccattattgaaaagtacctgagaaggcagctcacgaaacccaggcctgtgatcctggacccggcggaccctacaggaaacttgggtggtggagacccaaagggttggaggcagctggcacaagaggctgaggcctggctgaattacccatgctttaagaattgggatgggtccccagtgagctcctggattctgctggctgaaagcaacagtgcagacgatgagaccgacgatcccaggaggtatcagaaatatggttacattggaacacatgagtaccctcatttctctcatagacccagcacactccaggcagcatccaccccacaggcagaagaggactggacctgcaccatcctctgaatgccagtgcatcttgggggaaagggctccagtgttatctggaccagttccttcattttcaggtgggactcttgatccagagaggacaaagctcctcagtgagctggtgtataatccaggacagaacccaggtctcctgactcctggccttctatgccctctatcctatcatagataacattctccacagcctcacttcattccacctattctctgaaaatattccctgagagagaacagagagatttagataagagaatgaaattccagccttgactttcttctgtgcacctgatgggagggtaatgtctaatgtattatcaataacaataaaaataaagcaaataccatttaaaaaaaaaaa

SEQ ID NO: 110 - protein, 414 aa, Artificial Sequence
  OAS1
MMDLRNTPAKSLDKFIEDYLLPDTCFRMQINHAIDIICGFLKERCFRGSSYPVCVSKVVKGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGQLTGGYKPNPQIYVKLIEECTDLQKEGEFSTCFTELQRDFLKQRPTKLKSLIRLVKHWYQNCKKKLGKLPPQYALELLTVYAWERGSMKTHFNTAQGFRTVLELVINYQQLCIYWTKYYDFKNPIIEKYLRRQLTKPRPVILDPADPTGNLGGGDPKGWRQLAQEAEAWLNYPCFKNWDGSPVSSWILLTQHTPGSIHPTGRRGLDLHHPLNASASWGKGLQCYLDQFLHFQVGLLIQRGQSSSVSWCIIQDRTQVS

SEQ ID NO: 111 - protein, 360 aa, Artificial Sequence
  OAS1
MMDLRNTPAKSLDKFIEDYLLPDTCFRMQINHAIDIICGFLKERCFRGSSYPVCVSKVVKGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGQLTGGYKPNPQIYVKLIEECTDLQKEGEFSTCFTELQRDFLKQRPTKLKSLIRLVKHWYQNCKKKLGKLPPQYALELLTVYAWERGSMKTHFNTAQGFRTVLELVINYQQLCIYWTKYYDFKNPIIEKYLRRQLTKPRPVILDPADPTGNLGGGDPKGWRQLAQEAEAWLNYPCFKNWDGSPVSSWILLVNLTLVGRRNYTNN

SEQ ID NO: 112 - protein, 414 aa, Artificial Sequence
  OAS1
MMDLRNTPAKSLDKFIEDYLLPDTCFRMQINHAIDIICGFLKERCFRGSSYPVCVSKVVKGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGQLTGGYKPNPQIYVKLIEECTDLQKEGEFSTCFTELQRDFLKQRPTKLKSLIRLVKHWYQNCKKKLGKLPPQYALELLTVYAWERGSMKTHFNTAQGFRTVLELVINYQQLCIYWTKYYDFKNPIIEKYLRRQLTKPRPVILDPADPTGNLGGGDPKGWRQLAQEAEAWLNYPCFKNWDGSPVSSWILLVRPPASSLPFIPAPLHEAGDPKGWRQLAQEAEAWLNYPCFKNWDGSPVSSWILLVNLTLVGRRNYTNN

SEQ ID NO: 113 - protein, 400 aa, Artificial Sequence
  OAS1
MMDLRNTPAKSLDKFIEDYLLPDTCFRMQINHAIDIICGFLKERCFRGSSYPVCVSKVVKGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGQLTGGYKPNPQIYVKLIEECTDLQKEGEFSTCFTELQRDFLKQRPTKLKSLIRLVKHWYQNCKKKLGKLPPQYALELLTVYAWERGSMKTHFNTAQGFRTVLELVINYQQLCIYWTKYYDFKNPIIEKYLRRQLTKPRPVILDPADPTGNLGGGDPKGWRQLAQEAEAWLNYPCFKNWDGSPVSSWILLAESNSADDETDDPRRYQKYGYIGTHEYPHFSHRPSTLQAASTPQAEEDWTCTIL

SEQ ID NO: 114 - DNA, 1815 bp, Artificial Sequence
  PLTP
tttccttccctctccctgggcttgggtctcccacttgtccagacagcggccgggcttgtcacggggctctgtgcagccttttccactctcccggctgccagcgtcccgccccgtcccctcccagcccccaagggaggaggggagagctgcagagaggaggaggggtcggggaggccggctttataaaggcggctggaacaaccctgcccgccagaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccagg

SEQ ID NO: 115 - DNA, 1727 bp, Artificial Sequence
  PLTP
ataaaggccaagccagtcatcataggcgggaccaggcagatgggcgtggccttgaaaatgtagagggggccaagaaggaagcaggaccagtggatgtgaggcgtggtcgaagaacaacagaaagggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccagg

SEQ ID NO: 116 - DNA, 2100 bp, Artificial Sequence
  PLTP
tttccttccctctccctgggcttgggtctcccacttgtccagacagcggccgggcttgtcacggggctctgtgcagccttttccactctcccggctgccagcgtcccgccccgtcccctcccagcccccaagggaggaggggagagctgcagagaggaggaggggtcggggaggccggctttataaaggcggctggaacaaccctgcccgccagaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccagg

SEQ ID NO: 117 - DNA, 1944 bp, Artificial Sequence
  PLTP
tttccttccctctccctgggcttgggtctcccacttgtccagacagcggccgggcttgtcacggggctctgtgcagccttttccactctcccggctgccagcgtcccgccccgtcccctcccagcccccaagggaggaggggagagctgcagagaggaggaggggtcggggaggccggctttataaaggcggctggaacaaccctgcccgccagaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttgaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccagg

SEQ ID NO: 118 - protein, 398 aa, Artificial Sequence
  PLTP
MALFGALFLALLAGAHAEFPGCKIRVTSKALELVKQEGLRFLEQELETITIPDLRGKEGHFYYNISEKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 119 - protein, 405 aa, Artificial Sequence
  PLTP
MLQITNASLGLRFRRQLLYWFFYDGGYINASAEGVSIRTGLELSRDPAGRMKVSNVSCQASVSRMHAAFGGTFKKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 120 - protein, 493 aa, Artificial Sequence
  PLTP
MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFFYDGGYINASAEGVSIRTGLELSRDPAGRMKVSNVSCQASVSRMHAAFGGTFKKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 121 - protein, 441 aa, Artificial Sequence
  PLTP
MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFLKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 122 - DNA, 3029 bp, Artificial Sequence
  PGS4
aatgggagggctctttgatatcttcctcctcctcctccctgcgctgctccccaggagccagtggacacaagcagagggatacaaatttcgcgcgggcagcgctgaggtgggccgtaaagaggaacggaccggaagtggtggtggttatagcaaccagtgtggccagcctcttccccagcttatcctcctcccaatactcccgctctgtttttatgaggctgggaaaatagaacgaggaagtggtgacgcactgggctctcacgaatacaactagaagctgcaacgactgtgtggctctatcgattcgggagaggtccagaccggaaatggtcgtttccatggtaaccctgagcaggttgcctgggagatgacctctttcgggtctctttgaatctccgctgtagcgtcacctggaaggcagatctaacagagaacctggactgtctcctatcatgattcccgggaaatatcgctctgtttctggccgggctgcgaacaacgtgaactgcgggcttcatctggttattcaaacatcatcgcttcctgaaaaaaacaaagtaagatttaagaaggttgaattcaagctaaataaagacacatcgtcattccccggtagacttttacaacatgaccttgaaagaaactactcaagtaggcaaggtgatcatattaatttggtgagctcatcattgtcatcatttcctattcttcaacgttcttctgaagagaaaattctttactcagacaggttgagcctagaaagacaaaagctgaccgtatgtcctatcatcaatggggaagaccaccttcgtttgttgaactttcaacacaattttataactcggatacaaaatatttctaatctacagaagttaatatcgttggatttatatgataaccagattgaagaaattagtgggctttcgactctgagatgtcttcgtgtccttctgttggggaaaaacagaatcaagaaaatctcaaatctggagaatctaaaaagcttagatgtcttggatcttcatggaaatcagattaccaaaattgaaaatattaatcatttgtgtgagttgagagttttaaatcttgccaggaactttttaagtcatgttgataatcttaatgggctggattcactaactgaacttaacttgcgacacaatcaaatcactttcgtgagagatgtggataatttgccctgcctccaacatctctttctcagctttaacaatatatctagttttgacagtgtttcctgccttgctgactcttcttccctctcggacatcacctttgatggcaatcccatagctcaagagtcatggtacaaacacactgtccttcagaatatgatgcagctgcgccagctagatatgaagagaatcacggaagaagaaaggcgtatggcatctgttttagccaaaaaagaggaagagaagaagcgggaaagtcataaacaatctttgcttaaggagaagaaaaggttaacaattaacaacgtagctcgacagtgggacttgcaacaacaacgagtagccaatattgctacaaatgaagatagaaaagattctgactctcctcaggacccctgtcagattgatggaagcaccctctctgcattcccagaggaaacagggcctctagactcaggactcaacaatgctttacaaggtttatctgtcatagacacataccttgttgaagtggacggggatacactttccctatatggctcaggagcactggaatctctggataggaattggagtgttcaaacagcaggaatgatcacaacagtctccttcactttcatagaatttgatgaaatcgtccaagtgcttcctaaactgaagattaagtttcctaattctctgcaccttaaattcaaggaaacaaatcttgtaatgctgcagcaatttaacgcactagcccaactccgtcgtattgaccagttgacaattgatcctcaaggaaatccagttgtcaattttacactctggaaatactatgtactgtttaggctaagccatttcagtatgcagaaaataaatggaacagaggtgacacagaatgatatgataatggctgaaaggctctttggaatcctagcacatgtagcatcttctgagttaccccagtatcgtctgatttccattctgggtgatgccaggaaaaagcaatttcggtatctactagaatccaaaggaaaaaaacctggtattatcaacgaagaaaataatgacagcaaaagacttgtaggagaaaacacaaatcgtgctacattaaattatactacaagagacttttataatgaaaagctagaggaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagttacagttgattttggcagttttattttttgaaggttgaaaatatgcaggttatacatgttaaaacaacaacaacactatcctataaactagaaagactagtataaaagcattattgcccactgttctcatagctaaaagttaagaaggaaagaaggaaagcaggagaaaggaaggattaattgcctgtatgtgaggaccaaacaacctttgggaactaaacagttttcagagatggcgtggcactgcatccttggttcttgctttgattggtgccctgctatagcccaaagcacgtagtatttgctgatgattcagcatgagctgcatctacctacttttagctgataattttcagttatttccctttttattttatgtcatgatttcaaagccaaaaatatgttctttttatgagtgaagaataaacttactaacaaattagtcaaaataaagtatgtttgcctccttaaaaaaaaaaaaaaaaaa

SEQ ID NO: 123 - DNA, 3103 bp, Artificial Sequence
  PGS4
aatgggagggctctttgatatcttcctcctcctcctccctgcgctgctccccaggagccagtggacacaagcagagggatacaaatttcgcgcgggcagcgctgaggtgggccgtaaagaggaacggaccggaagtggtggtggttatagcaaccagtgtggccagcctcttccccagcttatcctcctcccaatactcccgctctgtttttatgaggctgggaaaatagaacgaggaagtggtgacgcactgggctctcacgaatacaactagaagctgcaacgactgtgtggctctatcgattcgggagaggtccagaccggaaatggtcgtttccatggtaaccctgagcaggttgcctgggagatgacctctttcgggtctctttgaatctccgctgtagcgtcacctggaaggcagatctaacagagaacctggactgtctcctatcatgattcccgggaaatatcgctctgtttctggccgggctgcgaacaacgtgaactgcgggcttcatctggttattcaaacatcatcgcttcctgaaaaaaacaaagttgaattcaagctaaataaagacacatcgtcattccccggtagacttttacaacatgaccttgaaagaaactactcaagtaggcaagattttaccaagaatataaagaatgtaaaatgaggtccatcacccaaggagcttgtagatttatttgggaagacaagggctacatatctggtgatcatattaatttggtgagctcatcattgtcatcatttcctattcttcaacgttcttctgaagagaaaattctttactcagacaggttgagcctagaaagacaaaagctgaccgtatgtcctatcatcaatggggaagaccaccttcgtttgttgaactttcaacacaattttataactcggatacaaaatatttctaatctacagaagttaatatcgttggatttatatgataaccagattgaagaaattagtgggctttcgactctgagatgtcttcgtgtccttctgttggggaaaaacagaatcaagaaaatctcaaatctggagaatctaaaaagcttagatgtcttggatcttcatggaaatcagattaccaaaattgaaaatattaatcatttgtgtgagttgagagttttaaatcttgccaggaactttttaagtcatgttgataatcttaatgggctggattcactaactgaacttaacttgcgacacaatcaaatcactttcgtgagagatgtggataatttgccctgcctccaacatctctttctcagctttaacaatatatctagttttgacagtgtttcctgccttgctgactcttcttccctctcggacatcacctttgatggcaatcccatagctcaagagtcatggtacaaacacactgtccttcagaatatgatgcagctgcgccagctagatatgaagagaatcacggaagaagaaaggcgtatggcatctgttttagccaaaaaagaggaagagaagaagcgggaaagtcataaacaatctttgcttaaggagaagaaaaggttaacaattaacaacgtagctcgacagtgggacttgcaacaacaacgagtagccaatattgctacaaatgaagatagaaaagattctgactctcctcaggacccctgtcagattgatggaagcaccctctctgcattcccagaggaaacagggcctctagactcaggactcaacaatgctttacaaggtttatctgtcatagacacataccttgttgaagtggacggggatacactttccctatatggctcaggagcactggaatctctggataggaattggagtgttcaaacagcaggaatgatcacaacagtctccttcactttcatagaatttgatgaaatcgtccaagtgcttcctaaactgaagattaagtttcctaattctctgcaccttaaattcaaggaaacaaatcttgtaatgctgcagcaatttaacgcactagcccaactccgtcgtattgaccagttgacaattgatcctcaaggaaatccagttgtcaattttacactctggaaatactatgtactgtttaggctaagccatttcagtatgcagaaaataaatggaacagaggtgacacagaatgatatgataatggctgaaaggctctttggaatcctagcacatgtagcatcttctgagttaccccagtatcgtctgatttccattctgggtgatgccaggaaaaagcaatttcggtatctactagaatccaaaggaaaaaaacctggtattatcaacgaagaaaataatgacagcaaaagacttgtaggagaaaacacaaatcgtgctacattaaattatactacaagagacttttataatgaaaagctagaggaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagttacagttgattttggcagttttattttttgaaggttgaaaatatgcaggttatacatgttaaaacaacaacaacactatcctataaactagaaagactagtataaaagcattattgcccactgttctcatagctaaaagttaagaaggaaagaaggaaagcaggagaaaggaaggattaattgcctgtatgtgaggaccaaacaacctttgggaactaaacagttttcagagatggcgtggcactgcatccttggttcttgctttgattggtgccctgctatagcccaaagcacgtagtatttgctgatgattcagcatgagctgcatctacctacttttagctgataattttcagttatttccctttttattttatgtcatgatttcaaagccaaaaatatgttctttttatgagtgaagaataaacttactaacaaattagtcaaaataaagtatgtttgcctccttaaaaaaaaaaaaaaaaaa

SEQ ID NO: 124 - DNA, 3061 bp, Artificial Sequence
  PGS4
agcaagatgatgcaaacataaaggtctggtgggaaaggctgtgtgaaaatgggaatcccccagggcggaggaagtaaagcagcaagtcctctatccgtctcaaattaccttgaaatcccacctcctggaatcccccatcagcaagtgtccgctgtacctggcctgctaccacctaaagactgagcgcagccagcaggactgggaaaggcagggcgatgatggcagtgaaggatggagtctcactctgtcgcctaggctggagtgccgtggtgcgatctcgctcactgcaacctccacctcccaggttcaagcaattctctgcctcagcatcccgagtagctgggattataggtgcccgccaccatgcccagctcatttttgtatttttagtagaggcggggtttcaccatcttggccaggctggtcttgaattcctgacctcaagtgatccacccgccttggcctcccaaagtgttgggattacaggagtgagccacctcgcccagccaacttgacataacttttaaagatggattgccaagctgaggtgaactgcgggcttcatctggttattcaaacatcatcgcttcctgaaaaaaacaaagttgaattcaagctaaataaagacacatcgtcattccccggtagacttttacaacatgaccttgaaagaaactactcaagtaggcaaggtgatcatattaatttggtgagctcatcattgtcatcatttcctattcttcaacgttcttctgaagagaaaattctttactcagacaggttgagcctagaaagacaaaagctgaccgtatgtcctatcatcaatggggaagaccaccttcgtttgttgaactttcaacacaattttataactcggatacaaaatatttctaatctacagaagttaatatcgttggatttatatgataaccagattgaagaaattagtgggctttcgactctgagatgtcttcgtgtccttctgttggggaaaaacagaatcaagaaaatctcaaatctggagaatctaaaaagcttagatgtcttggatcttcatggaaatcagattaccaaaattgaaaatattaatcatttgtgtgagttgagagttttaaatcttgccaggaactttttaagtcatgttgataatcttaatgggctggattcactaactgaacttaacttgcgacacaatcaaatcactttcgtgagagatgtggataatttgccctgcctccaacatctctttctcagctttaacaatatatctagttttgacagtgtttcctgccttgctgactcttcttccctctcggacatcacctttgatggcaatcccatagctcaagagtcatggtacaaacacactgtccttcagaatatgatgcagctgcgccagctagatatgaagagaatcacggaagaagaaaggcgtatggcatctgttttagccaaaaaagaggaagagaagaagcgggaaagtcataaacaatctttgcttaaggagaagaaaaggttaacaattaacaacgtagctcgacagtgggacttgcaacaacaacgagtagccaatattgctacaaatgaagatagaaaagattctgactctcctcaggacccctgtcagattgatggaagcaccctctctgcattcccagaggaaacagggcctctagactcaggactcaacaatgctttacaaggtttatctgtcatagacacataccttgttgaagtggacggggatacactttccctatatggctcaggagcactggaatctctggataggaattggagtgttcaaacagcaggaatgatcacaacagtctccttcactttcatagaatttgatgaaatcgtccaagtgcttcctaaactgaagattaagtttcctaattctctgcaccttaaattcaaggaaacaaatcttgtaatgctgcagcaatttaacgcactagcccaactccgtcgtattgaccagttgacaattgatcctcaaggaaatccagttgtcaattttacactctggaaatactatgtactgtttaggctaagccatttcagtatgcagaaaataaatggaacagaggtgacacagaatgatatgataatggctgaaaggctctttggaatcctagcacatgtagcatcttctgagttaccccagtatcgtctgatttccattctgggtgatgccaggaaaaagcaatttcggtatctactagaatccaaaggaaaaaaacctggtattatcaacgaagaaaataatgacagcaaaagacttgtaggagaaaacacaaatcgtgctacattaaattatactacaagagacttttataatgaaaagctagaggaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagttacagttgattttggcagttttattttttgaaggttgaaaatatgcaggttatacatgttaaaacaacaacaacactatcctataaactagaaagactagtataaaagcattattgcccactgttctcatagctaaaagttaagaaggaaagaaggaaagcaggagaaaggaaggattaattgcctgtatgtgaggaccaaacaacctttgggaactaaacagttttcagagatggcgtggcactgcatccttggttcttgctttgattggtgccctgctatagcccaaagcacgtagtatttgctgatgattcagcatgagctgcatctacctacttttagctgataattttcagttatttccctttttattttatgtcatgatttcaaagccaaaaatatgttctttttatgagtgaagaataaacttactaacaaattagtcaaaataaagtatgtttgcctccttaaaaaaaaaaaaaaaaaa

SEQ ID NO: 125 - DNA, 3014 bp, Artificial Sequence
  PGS4
aatgggagggctctttgatatcttcctcctcctcctccctgcgctgctccccaggagccagtggacacaagcagagggatacaaatttcgcgcgggcagcgctgaggtgggccgtaaagaggaacggaccggaagtggtggtggttatagcaaccagtgtggccagcctcttccccagcttatcctcctcccaatactcccgctctgtttttatgaggctgggaaaatagaacgaggaagtggtgacgcactgggctctcacgaatacaactagaagctgcaacgactgtgtggctctatcgattcgggagaggtccagaccggaaatggtcgtttccatggtaaccctgagcaggttgcctgggagatgacctctttcgggtctctttgaatctccgctgtagcgtcacctggaaggcagatctaacagagaacctggactgtctcctatcatgattcccgggaaatatcgctctgtttctggccgggctgcgaacaacgtgaactgcgggcttcatctggttattcaaacatcatcgcttcctgaaaaaaacaaagttgaattcaagctaaataaagacacatcgtcattccccggtagacttttacaacatgaccttgaaagaaactactcaagtaggcaaggtgatcatattaatttggtgagctcatcattgtcatcatttcctattcttcaacgttcttctgaagagaaaattctttactcagacaggttgagcctagaaagacaaaagctgaccgtatgtcctatcatcaatggggaagaccaccttcgtttgttgaactttcaacacaattttataactcggatacaaaatatttctaatctacagaagttaatatcgttggatttatatgataaccagattgaagaaattagtgggctttcgactctgagatgtcttcgtgtccttctgttggggaaaaacagaatcaagaaaatctcaaatctggagaatctaaaaagcttagatgtcttggatcttcatggaaatcagattaccaaaattgaaaatattaatcatttgtgtgagttgagagttttaaatcttgccaggaactttttaagtcatgttgataatcttaatgggctggattcactaactgaacttaacttgcgacacaatcaaatcactttcgtgagagatgtggataatttgccctgcctccaacatctctttctcagctttaacaatatatctagttttgacagtgtttcctgccttgctgactcttcttccctctcggacatcacctttgatggcaatcccatagctcaagagtcatggtacaaacacactgtccttcagaatatgatgcagctgcgccagctagatatgaagagaatcacggaagaagaaaggcgtatggcatctgttttagccaaaaaagaggaagagaagaagcgggaaagtcataaacaatctttgcttaaggagaagaaaaggttaacaattaacaacgtagctcgacagtgggacttgcaacaacaacgagtagccaatattgctacaaatgaagatagaaaagattctgactctcctcaggacccctgtcagattgatggaagcaccctctctgcattcccagaggaaacagggcctctagactcaggactcaacaatgctttacaaggtttatctgtcatagacacataccttgttgaagtggacggggatacactttccctatatggctcaggagcactggaatctctggataggaattggagtgttcaaacagcaggaatgatcacaacagtctccttcactttcatagaatttgatgaaatcgtccaagtgcttcctaaactgaagattaagtttcctaattctctgcaccttaaattcaaggaaacaaatcttgtaatgctgcagcaatttaacgcactagcccaactccgtcgtattgaccagttgacaattgatcctcaaggaaatccagttgtcaattttacactctggaaatactatgtactgtttaggctaagccatttcagtatgcagaaaataaatggaacagaggtgacacagaatgatatgataatggctgaaaggctctttggaatcctagcacatgtagcatcttctgagttaccccagtatcgtctgatttccattctgggtgatgccaggaaaaagcaatttcggtatctactagaatccaaaggaaaaaaacctggtattatcaacgaagaaaataatgacagcaaaagacttgtaggagaaaacacaaatcgtgctacattaaattatactacaagagacttttataatgaaaagctagaggaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagttacagttgattttggcagttttattttttgaaggttgaaaatatgcaggttatacatgttaaaacaacaacaacactatcctataaactagaaagactagtataaaagcattattgcccactgttctcatagctaaaagttaagaaggaaagaaggaaagcaggagaaaggaaggattaattgcctgtatgtgaggaccaaacaacctttgggaactaaacagttttcagagatggcgtggcactgcatccttggttcttgctttgattggtgccctgctatagcccaaagcacgtagtatttgctgatgattcagcatgagctgcatctacctacttttagctgataattttcagttatttccctttttattttatgtcatgatttcaaagccaaaaatatgttctttttatgagtgaagaataaacttactaacaaattagtcaaaataaagtatgtttgcctccttaaaaaaaaaaaaaaaaaa

SEQ ID NO: 126 - protein, 691 aa, Artificial Sequence
  PGS4
MIPGKYRSVSGRAANNVNCGLHLVIQTSSLPEKNKVRFKKVEFKLNKDTSSFPGRLLQHDLERNYSSRQGDHINLVSSSLSSFPILQRSSEEKILYSDRLSLERQKLTVCPIINGEDHLRLLNFQHNFITRIQNISNLQKLISLDLYDNQIEEISGLSTLRCLRVLLLGKNRIKKISNLENLKSLDVLDLHGNQITKIENINHLCELRVLNLARNFLSHVDNLNGLDSLTELNLRHNQITFVRDVDNLPCLQHLFLSFNNISSFDSVSCLADSSSLSDITFDGNPIAQESWYKHTVLQNMMQLRQLDMKRITEEERRMASVLAKKEEEKKRESHKQSLLKEKKRLTINNVARQWDLQQQRVANIATNEDRKDSDSPQDPCQIDGSTLSAFPEETGPLDSGLNNALQGLSVIDTYLVEVDGDTLSLYGSGALESLDRNWSVQTAGMITTVSFTFIEFDEIVQVLPKLKIKFPNSLHLKFKETNLVMLQQFNALAQLRRIDQLTIDPQGNPVVNFTLWKYYVLFRLSHFSMQKINGTEVTQNDMIMAERLFGILAHVASSELPQYRLISILGDARKKQFRYLLESKGKKPGIINEENNDSKRLVGENTNRATLNYTTRDFYNEKLEEIKEKKKFCKTYIEDLVKEATEINMKNEALQKLWPQMFIELVRDAVIEIRNKNSYMKLCLQQITDQK

SEQ ID NO: 127 - protein, 642 aa, Artificial Sequence
  PGS4
MRSITQGACRFIWEDKGYISGDHINLVSSSLSSFPILQRSSEEKILYSDRLSLERQKLTVCPIINGEDHLRLLNFQHNFITRIQNISNLQKLISLDLYDNQIEEISGLSTLRCLRVLLLGKNRIKKISNLENLKSLDVLDLHGNQITKIENINHLCELRVLNLARNFLSHVDNLNGLDSLTELNLRHNQITFVRDVDNLPCLQHLFLSFNNISSFDSVSCLADSSSLSDITFDGNPIAQESWYKHTVLQNMMQLRQLDMKRITEEERRMASVLAKKEEEKKRESHKQSLLKEKKRLTINNVARQWDLQQQRVANIATNEDRKDSDSPQDPCQIDGSTLSAFPEETGPLDSGLNNALQGLSVIDTYLVEVDGDTLSLYGSGALESLDRNWSVQTAGMITTVSFTFIEFDEIVQVLPKLKIKFPNSLHLKFKETNLVMLQQFNALAQLRRIDQLTIDPQGNPVVNFTLWKYYVLFRLSHFSMQKINGTEVTQNDMIMAERLFGILAHVASSELPQYRLISILGDARKKQFRYLLESKGKKPGIINEENNDSKRLVGENTNRATLNYTTRDFYNEKLEEIKEKKKFCKTYIEDLVKEATEINMKNEALQKLWPQMFIELVRDAVIEIRNKNSYMKLCLQQITDQK

SEQ ID NO: 128 - protein, 676 aa, Artificial Sequence
  PGS4
MDCQAEVNCGLHLVIQTSSLPEKNKVEFKLNKDTSSFPGRLLQHDLERNYSSRQGDHINLVSSSLSSFPILQRSSEEKILYSDRLSLERQKLTVCPIINGEDHLRLLNFQHNFITRIQNISNLQKLISLDLYDNQIEEISGLSTLRCLRVLLLGKNRIKKISNLENLKSLDVLDLHGNQITKIENINHLCELRVLNLARNFLSHVDNLNGLDSLTELNLRHNQITFVRDVDNLPCLQHLFLSFNNISSFDSVSCLADSSSLSDITFDGNPIAQESWYKHTVLQNMMQLRQLDMKRITEEERRMASVLAKKEEEKKRESHKQSLLKEKKRLTINNVARQWDLQQQRVANIATNEDRKDSDSPQDPCQIDGSTLSAFPEETGPLDSGLNNALQGLSVIDTYLVEVDGDTLSLYGSGALESLDRNWSVQTAGMITTVSFTFIEFDEIVQVLPKLKIKFPNSLHLKFKETNLVMLQQFNALAQLRRIDQLTIDPQGNPVVNFTLWKYYVLFRLSHFSMQKINGTEVTQNDMIMAERLFGILAHVASSELPQYRLISILGDARKKQFRYLLESKGKKPGIINEENNDSKRLVGENTNRATLNYTTRDFYNEKLEEIKEKKKFCKTYIEDLVKEATEINMKNEALQKLWPQMFIELVRDAVIEIRNKNSYMKLCLQQITDQK

SEQ ID NO: 129 - protein, 686 aa, Artificial Sequence
  PGS4
MIPGKYRSVSGRAANNVNCGLHLVIQTSSLPEKNKVEFKLNKDTSSFPGRLLQHDLERNYSSRQGDHINLVSSSLSSFPILQRSSEEKILYSDRLSLERQKLTVCPIINGEDHLRLLNFQHNFITRIQNISNLQKLISLDLYDNQIEEISGLSTLRCLRVLLLGKNRIKKISNLENLKSLDVLDLHGNQITKIENINHLCELRVLNLARNFLSHVDNLNGLDSLTELNLRHNQITFVRDVDNLPCLQHLFLSFNNISSFDSVSCLADSSSLSDITFDGNPIAQESWYKHTVLQNMMQLRQLDMKRITEEERRMASVLAKKEEEKKRESHKQSLLKEKKRLTINNVARQWDLQQQRVANIATNEDRKDSDSPQDPCQIDGSTLSAFPEETGPLDSGLNNALQGLSVIDTYLVEVDGDTLSLYGSGALESLDRNWSVQTAGMITTVSFTFIEFDEIVQVLPKLKIKFPNSLHLKFKETNLVMLQQFNALAQLRRIDQLTIDPQGNPVVNFTLWKYYVLFRLSHFSMQKINGTEVTQNDMIMAERLFGILAHVASSELPQYRLISILGDARKKQFRYLLESKGKKPGIINEENNDSKRLVGENTNRATLNYTTRDFYNEKLEEIKEKKKFCKTYIEDLVKEATEINMKNEALQKLWPQMFIELVRDAVIEIRNKNSYMKLCLQQITDQK

SEQ ID NO: 130 - DNA, 2688 bp, Artificial Sequence
  RNF128
atagagctgatgtatccagaggttatgttgctagaggtgagatcagttacctacgtgcaactgaaatttcaaacttctgttcagcagggacgtgagtggacaatggtgactgatagttggaaatatcagcaaacatcttaaattttatactcaaatgaatgagcaatgaaccaggagaataggtccagttttttttggctccttgtaatttttacctttttacttaaaattacagcatctttttcaatgagtgcctatgtgactgtgacttattacaatgaaaccagcaactacactgcaatagagacatgtgaatgtggcgtttatggattagcttcaccagtggctaatgctatgggagtggtaggcatccctaagaacaataactaccaagcttgtgaccacaacactgagtttagtaatactaagaagccctggattgcgctgatagaaagaggtaattgtacattttcagaaaaaattcaaacagcgggcagaagaaatgctgatgctgttgtgatttacaatgctccagagactggcaatcagacgatacagatggcaaattttggtgcagtagacattgttgcaatcatgatcggcaatctgaaaggcacaaaaattctgcaatctattcaaagaggcatacaagtgacaatggtcatagaagtagggaaaaaacatggcccttgggtgaatcactattcaatttttttcgtttctgtgtccttttttattattacggcggcaactgtgggctattttatcttttattctgctcgaaggctacggaatgcaagagctcaaagcaggaagcagaggcaattaaaggcagatgctaaaaaagctattggaaggcttcaactacgcacactgaaacaaggagacaaggaaattggccctgatggagatagttgtgctgtgtgcattgaattgtataaaccaaatgatttggtacgcatcttaacgtgcaaccatattttccataagacatgtgttgacccatggctgttagaacacaggacttgccccatgtgcaaatgtgacatactcaaagctttgggaattgaggtggatgttgaagatggatcagtgtctttacaagtccctgtatccaatgaaatatctaatagtgcctcctcccatgaagaggataatcgcagcgagaccgcatcatctggatatgcttcagtacagggaacagatgaaccgcctctggaggaacacgtgcagtcaacaaatgaaagtctacagctggtaaaccatgaagcaaattctgtggcagtggatgttattcctcatgttgacaacccaacctttgaagaagacgaaactcctaatcaagagactgctgttcgagaaattaaatcttaaaatctgtgtaaatagaaaacttgaaccattagtaataacagaactgccaatcagggcctagtttctattaataaattggataaatttaataaaataagagtgatactgaaagtgctcagatgactaatattatgctatagttaaatggcttaaaatatttaacctgttaacttttttccacaaactcattataatatttttcataggcaagtttcctctcagtagtgataacaacatttttagacattcaaaactgtcttcaagaagtcacgtttttcatttataacaattttcttataaaaacatgttgcttttaaaatgtggagtagctgtaatcactttattttatgatagtatcttaatgaaaaatactacttctttagcttgggctacatgtgtcagggtttttctccaggtgcttatattgatctggaattgtaatgtaaaaagcaatgcaaacttaggcgagtacttcttgaaatgtctatttaagctgctttaagttaatagaaaagattaaagcaaaatattcatttttactttttcttatttttaaaattaggctgaatgtacttcatgtgatttgtcaaccatagtttatcagagattatggacttaattgattggtatattagtgacatcaacttgacacaagattagacaaaaaattccttacaaaaatactgtgtaactatttctcaaacttgtgggatttttcaaaagctcagtatatgaatcatcatactgtttgaaattgctaatgacagagtaagtaacactaatattggtcattgatcttcgttcatgaattagtctacagaaaaaaaatgttctgtaaaattagtctgttgaaaatgttttccaaacaatgttactttgaaaattgagtttatgtttgacctaaatgggctaaaattacattagataaactaaaattctgtccgtgtaactataaattttgtgaatgcattttcctggtgtttgaaaaagaagggggggagaattccaggtgccttaatataaagtttgaagcttcatccaccaaagttaaatagagctatttaaaaatgcactttatttgtactctgtgtggcttttgttttagaattttgttcaaattatagcagaatttaggcaaaaataaaacagacatgtatttttgtttgctgaatggatgaaaccattgcattcttgtacactgatttgaaatgctgtaaatatgtcccaatttgtattgattctctttaaatataaaatgtaaataaaatattccaataaaagtttgtgtctggtgttagtttaaaaaaaaaaaaa

SEQ ID NO: 131 - DNA, 2851 bp, Artificial Sequence
  RNF128
gcttcacgctaaagccccagagcccgacgcggcagccgcggtagcggagaagactggagctccgaggagctgcatctgcggcaacctgtgtgctgacgctacgtgcctcctggctccgacgtagctcgcagctccccagtctcactccattccttccccacctggcgcgcacctgctcaagaccagggtcctgccaagcgctaggagggcgcgtgccaggggcgctagggaactgcggagcgcgcgcgccatggggccgccgcctggggccggggtctcctgccgcggtggctgcggcttttccagattgctggcatggtgcttcctgctggccctgagtccgcaggcacccggttcccggggggctgaagcagtgtggaccgcgtacctcaacgtgtcctggcgggttccgcacacgggagtgaaccgtacggtgtgggagctgagcgaggagggcgtgtacggccaggactcgccgctggagcctgtggctggggtcctggtaccgcccgacgggcccggggcgcttaacgcctgtaacccgcacacgaatttcacggtgcccacggtttggggaagcaccgtgcaagtctcttggttggccctcatccaacgcggcgggggctgcaccttcgcagacaagatccatctggcttatgagagaggggcgtctggagccgtcatctttaacttccccgggacccgcaatgaggtcatccccatgtctcacccgggtgcagtagacattgttgcaatcatgatcggcaatctgaaaggcacaaaaattctgcaatctattcaaagaggcatacaagtgacaatggtcatagaagtagggaaaaaacatggcccttgggtgaatcactattcaatttttttcgtttctgtgtccttttttattattacggcggcaactgtgggctattttatcttttattctgctcgaaggctacggaatgcaagagctcaaagcaggaagcagaggcaattaaaggcagatgctaaaaaagctattggaaggcttcaactacgcacactgaaacaaggagacaaggaaattggccctgatggagatagttgtgctgtgtgcattgaattgtataaaccaaatgatttggtacgcatcttaacgtgcaaccatattttccataagacatgtgttgacccatggctgttagaacacaggacttgccccatgtgcaaatgtgacatactcaaagctttgggaattgaggtggatgttgaagatggatcagtgtctttacaagtccctgtatccaatgaaatatctaatagtgcctcctcccatgaagaggataatcgcagcgagaccgcatcatctggatatgcttcagtacagggaacagatgaaccgcctctggaggaacacgtgcagtcaacaaatgaaagtctacagctggtaaaccatgaagcaaattctgtggcagtggatgttattcctcatgttgacaacccaacctttgaagaagacgaaactcctaatcaagagactgctgttcgagaaattaaatcttaaaatctgtgtaaatagaaaacttgaaccattagtaataacagaactgccaatcagggcctagtttctattaataaattggataaatttaataaaataagagtgatactgaaagtgctcagatgactaatattatgctatagttaaatggcttaaaatatttaacctgttaacttttttccacaaactcattataatatttttcataggcaagtttcctctcagtagtgataacaacatttttagacattcaaaactgtcttcaagaagtcacgtttttcatttataacaattttcttataaaaacatgttgcttttaaaatgtggagtagctgtaatcactttattttatgatagtatcttaatgaaaaatactacttctttagcttgggctacatgtgtcagggtttttctccaggtgcttatattgatctggaattgtaatgtaaaaagcaatgcaaacttaggcgagtacttcttgaaatgtctatttaagctgctttaagttaatagaaaagattaaagcaaaatattcatttttactttttcttatttttaaaattaggctgaatgtacttcatgtgatttgtcaaccatagtttatcagagattatggacttaattgattggtatattagtgacatcaacttgacacaagattagacaaaaaattccttacaaaaatactgtgtaactatttctcaaacttgtgggatttttcaaaagctcagtatatgaatcatcatactgtttgaaattgctaatgacagagtaagtaacactaatattggtcattgatcttcgttcatgaattagtctacagaaaaaaaatgttctgtaaaattagtctgttgaaaatgttttccaaacaatgttactttgaaaattgagtttatgtttgacctaaatgggctaaaattacattagataaactaaaattctgtccgtgtaactataaattttgtgaatgcattttcctggtgtttgaaaaagaagggggggagaattccaggtgccttaatataaagtttgaagcttcatccaccaaagttaaatagagctatttaaaaatgcactttatttgtactctgtgtggcttttgttttagaattttgttcaaattatagcagaatttaggcaaaaataaaacagacatgtatttttgtttgctgaatggatgaaaccattgcattcttgtacactgatttgaaatgctgtaaatatgtcccaatttgtattgattctctttaaatataaaatgtaaataaaatattccaataaaagtttgtgtctggtgttagtttaaaaaaaaaaaaa

SEQ ID NO: 132 - protein, 402 aa, Artificial Sequence
  RNF128
MNQENRSSFFWLLVIFTFLLKITASFSMSAYVTVTYYNETSNYTAIETCECGVYGLASPVANAMGVVGIPKNNNYQACDHNTEFSNTKKPWIALIERGNCTFSEKIQTAGRRNADAVVIYNAPETGNQTIQMANFGAVDIVAIMIGNLKGTKILQSIQRGIQVTMVIEVGKKHGPWVNHYSIFFVSVSFFIITAATVGYFIFYSARRLRNARAQSRKQRQLKADAKKAIGRLQLRTLKQGDKEIGPDGDSCAVCIELYKPNDLVRILTCNHIFHKTCVDPWLLEHRTCPMCKCDILKALGIEVDVEDGSVSLQVPVSNEISNSASSHEEDNRSETASSGYASVQGTDEPPLEEHVQSTNESLQLVNHEANSVAVDVIPHVDNPTFEEDETPNQETAVREIKS

SEQ ID NO: 133 - protein, 428 aa, Artificial Sequence
  RNF128
MGPPPGAGVSCRGGCGFSRLLAWCFLLALSPQAPGSRGAEAVWTAYLNVSWRVPHTGVNRTVWELSEEGVYGQDSPLEPVAGVLVPPDGPGALNACNPHTNFTVPTVWGSTVQVSWLALIQRGGGCTFADKIHLAYERGASGAVIFNFPGTRNEVIPMSHPGAVDIVAIMIGNLKGTKILQSIQRGIQVTMVIEVGKKHGPWVNHYSIFFVSVSFFIITAATVGYFIFYSARRLRNARAQSRKQRQLKADAKKAIGRLQLRTLKQGDKEIGPDGDSCAVCIELYKPNDLVRILTCNHIFHKTCVDPWLLEHRTCPMCKCDILKALGIEVDVEDGSVSLQVPVSNEISNSASSHEEDNRSETASSGYASVQGTDEPPLEEHVQSTNESLQLVNHEANSVAVDVIPHVDNPTFEEDETPNQETAVREIKS

SEQ ID NO: 134 - DNA, 862 bp, Artificial Sequence
  BEX1
cttggcggtgacgcacggccctcacgtgaccgggagctgcagagctacgcagccttcggtgcagtcgtcactcgtgtctcgctaccagctccccgctgccctgcgctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcataggcttggagaaccacaggcaaggatgagagaagagaatatggaaaggattggggaggaggtgagacagctgatggaaaagctgagggaaaagcagttgagtcatagtctgcgggcagtcagcactgacccccctcaccatgaccatcatgatgagttttgccttatgccctgaatcctgatggtttccctaaagttattacggaaacagacccctgctttcgaatttacatgttcatgatgtgcccttgttgtaaacctttacctgtcacttgtttacgtgggtctcctattaccagcttctaattgaatattgtgtttttgaaccagtctgtaagatttttgttagcagaagaattttacctattgcatggaaagatgctcattatagtgaagttaataaagcacctttaaaaagc

SEQ ID NO: 135 - protein, 125 aa, Artificial Sequence
  BEX1
MESKEKRAVNSLSMENANQENEEKEQVANKGEPLALPLDAGEYCVPRGNRRRFRVRQPILQYRWDMMHRLGEPQARMREENMERIGEEVRQLMEKLREKQLSHSLRAVSTDPPHHDHHDEFCLMP

SEQ ID NO: 136 - DNA, 4470 bp, Artificial Sequence
  HDAC9
acatcgcgcagcgcgcaccgagccggccgcgccgcgcccgccgctctcgccgctttcgccgcggtctcctcctctagcgcccgccgcggccggtaaatctcggctggaggagcagcggcggcccccgagtcaactttcattccctttttgcttctgcctcaccattctcttctcctcctcgaaagatggctgtttggagaagggggagaagttaagaggtcgccagcgcggagcgaaggagggcgcgatagcctcagcaggagcgggcggaggtttctcctctgccaacccctcctggaccattgtcagcagttgaacgacaaaggctgtgaatctgcatcctagtcttagcagtccctctgattctcatgatgagctcacctgcacagcctgacctcatgtggaaccttgtaccatgggtgctattctgtggctgctgtaggatcttcccagatggggtggctggacgagagcagctcttggctcagcaaagaatgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattagtttttgattttttgcaacatctagaatttaattttcacatcactgtacataatgtatcatactatagtcttgaacactgttaaaggtagtctgccccttccttcctctctctttttttagttaagtagaaatgttctggtcaccatgccagtagtcctaggttattgtgtaggttgcaattgaacatattaggaatacaggtggttttaaatatatagatgcaaattgcagcactactttaaatattagattatgtctcacatagcactgctcattttacttttattttgtgtaatttgatgacactgtctatcaaaaaagagcaaatgaagcagatgcaaatgttagtgagaagtaatgtgcagcattatggtccaatcagatacaatattgtgtctacaattgcaaaaaacacagtaacaggatgaatattatctgatatcaagtcaaaatcagtttgaaaagaaggtgtatcatattttatattgtcactagaatctcttaagtataattccataatgacatgggcatataccgtaacattctggcaaataacaattagaaaagataggtttaacaaaaaaatttacttgtatataatgcaccttcaggaggactatgtcctttgatgctataaaatacaaacaactttgaaggcaacagaagacactgtttattcaagtcagttctttgtcaggttcctgctgttctcctacagaaaagtgattctgtgagggtgaacaggaaatgccttgtggaaacaggaagtccaagtgattcatgtactgaggaatgtaggaaaaaaaatctgaggatagtgctttactctttctgtttttaaagggcactctatgaattgatttattgtctaagaaaataacaccacaagtagggaaattgttacggaagcttttcactggaacatttccttcatattcccttttgatatgtttaccttgttttataggtttacttttgttaagctagttaaaggttcgttgtattaagacccctttaatatggataatccaaattgacctagaatctttgtgaggttttttctattaaaatatttatatttctaaatccgaggtatttcaaggtgtagtatcctatttcaaaggagatatagcagttttgccaaatgtagacattgttcaactgtatgttattggcacgtgttgtttacattttgctgtgacatttaaaaatatttctttaaaaatgttactgctaaagatacattatccttttttaaaaagtctccattcaaattaaattaacataactagaagttagaaagtttaaaagttttccacataatgaaagtccttctgataatttgacaaatagctataataggaacactccctatcaccaacatattttggttagtatattccttcatattaaaatgactttttgtcagttgttttgcattaaaaatatggcatgcctaagataaaattgtatattttttccatctcataaatattcattttcttcaaagtcttttttcaatctcataaaaaagggatagtgcatcttttaaaatacattttatttggggaggaacatgtggctgagcagacttttgtataatattacttcaaagatatgtaatcacaaacaaaaaaaactattttttataatgtcatttgagagagtttcatcagtacagttggtggacgttaattgtttgaatttgatagtctttgaatttaatcaagaaactacctggaaccagtgaaaaggaaagctggacttaaataatcttagaattaattgataaatgtctcttttaaaatctactgtatttattataatttacacccttgaaggtgatctcttgttttgtgttgtaaatatattgtttgtatgtttcccttcttgccttctgttataagtctcttcctttctcaaataaagttttttttaaaagaaaaaaaaaaaaaaaaaaaa

SEQ ID NO: 137 - DNA, 4162 bp, Artificial Sequence
  HDAC9
gctttagccaacttgagctgagagagactgagaaagggggaagagaggcacagacacagataggagaagggcaccggctggagccacttgcaggactgagggtttttgcaacaaaaccctagcagcctgaagaactctaagccagatggggtggctggacgagagcagctcttggctcagcaaagaatgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattagtttttgattttttgcaacatctagaatttaattttcacatcactgtacataatgtatcatactatagtcttgaacactgttaaaggtagtctgccccttccttcctctctctttttttagttaagtagaaatgttctggtcaccatgccagtagtcctaggttattgtgtaggttgcaattgaacatattaggaatacaggtggttttaaatatatagatgcaaattgcagcactactttaaatattagattatgtctcacatagcactgctcattttacttttattttgtgtaatttgatgacactgtctatcaaaaaagagcaaatgaagcagatgcaaatgttagtgagaagtaatgtgcagcattatggtccaatcagatacaatattgtgtctacaattgcaaaaaacacagtaacaggatgaatattatctgatatcaagtcaaaatcagtttgaaaagaaggtgtatcatattttatattgtcactagaatctcttaagtataattccataatgacatgggcatataccgtaacattctggcaaataacaattagaaaagataggtttaacaaaaaaatttacttgtatataatgcaccttcaggaggactatgtcctttgatgctataaaatacaaacaactttgaaggcaacagaagacactgtttattcaagtcagttctttgtcaggttcctgctgttctcctacagaaaagtgattctgtgagggtgaacaggaaatgccttgtggaaacaggaagtccaagtgattcatgtactgaggaatgtaggaaaaaaaatctgaggatagtgctttactctttctgtttttaaagggcactctatgaattgatttattgtctaagaaaataacaccacaagtagggaaattgttacggaagcttttcactggaacatttccttcatattcccttttgatatgtttaccttgttttataggtttacttttgttaagctagttaaaggttcgttgtattaagacccctttaatatggataatccaaattgacctagaatctttgtgaggttttttctattaaaatatttatatttctaaatccgaggtatttcaaggtgtagtatcctatttcaaaggagatatagcagttttgccaaatgtagacattgttcaactgtatgttattggcacgtgttgtttacattttgctgtgacatttaaaaatatttctttaaaaatgttactgctaaagatacattatccttttttaaaaagtctccattcaaattaaattaacataactagaagttagaaagtttaaaagttttccacataatgaaagtccttctgataatttgacaaatagctataataggaacactccctatcaccaacatattttggttagtatattccttcatattaaaatgactttttgtcagttgttttgcattaaaaatatggcatgcctaagataaaattgtatattttttccatctcataaatattcattttcttcaaagtcttttttcaatctcataaaaaagggatagtgcatcttttaaaatacattttatttggggaggaacatgtggctgagcagacttttgtataatattacttcaaagatatgtaatcacaaacaaaaaaaactattttttataatgtcatttgagagagtttcatcagtacagttggtggacgttaattgtttgaatttgatagtctttgaatttaatcaagaaactacctggaaccagtgaaaaggaaagctggacttaaataatcttagaattaattgataaatgtctcttttaaaatctactgtatttattataatttacacccttgaaggtgatctcttgttttgtgttgtaaatatattgtttgtatgtttcccttcttgccttctgttataagtctcttcctttctcaaataaagttttttttaaaagaaaaaaaaaaaaaaaaaaaa

SEQ ID NO: 138 - DNA, 4340 bp, Artificial Sequence
  HDAC9
gctttagccaacttgagctgagagagactgagaaagggggaagagaggcacagacacagataggagaagggcaccggctggagccacttgcaggactgagggtttttgcaacaaaaccctagcagcctgaagaactctaagccaggtttaattggtttctttttctcgtgggtagacttaataattttctacgtattctgacaaagaaataaccccgaagcacgttcctatttcccacctgcttgtagtttccgggataacctaaactccagagagctatagcatccactctgtcctttctgctttgcacacagatggggtggctggacgagagcagctcttggctcagcaaagaatgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaagttgcaacaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattagtttttgattttttgcaacatctagaatttaattttcacatcactgtacataatgtatcatactatagtcttgaacactgttaaaggtagtctgccccttccttcctctctctttttttagttaagtagaaatgttctggtcaccatgccagtagtcctaggttattgtgtaggttgcaattgaacatattaggaatacaggtggttttaaatatatagatgcaaattgcagcactactttaaatattagattatgtctcacatagcactgctcattttacttttattttgtgtaatttgatgacactgtctatcaaaaaagagcaaatgaagcagatgcaaatgttagtgagaagtaatgtgcagcattatggtccaatcagatacaatattgtgtctacaattgcaaaaaacacagtaacaggatgaatattatctgatatcaagtcaaaatcagtttgaaaagaaggtgtatcatattttatattgtcactagaatctcttaagtataattccataatgacatgggcatataccgtaacattctggcaaataacaattagaaaagataggtttaacaaaaaaatttacttgtatataatgcaccttcaggaggactatgtcctttgatgctataaaatacaaacaactttgaaggcaacagaagacactgtttattcaagtcagttctttgtcaggttcctgctgttctcctacagaaaagtgattctgtgagggtgaacaggaaatgccttgtggaaacaggaagtccaagtgattcatgtactgaggaatgtaggaaaaaaaatctgaggatagtgctttactctttctgtttttaaagggcactctatgaattgatttattgtctaagaaaataacaccacaagtagggaaattgttacggaagcttttcactggaacatttccttcatattcccttttgatatgtttaccttgttttataggtttacttttgttaagctagttaaaggttcgttgtattaagacccctttaatatggataatccaaattgacctagaatctttgtgaggttttttctattaaaatatttatatttctaaatccgaggtatttcaaggtgtagtatcctatttcaaaggagatatagcagttttgccaaatgtagacattgttcaactgtatgttattggcacgtgttgtttacattttgctgtgacatttaaaaatatttctttaaaaatgttactgctaaagatacattatccttttttaaaaagtctccattcaaattaaattaacataactagaagttagaaagtttaaaagttttccacataatgaaagtccttctgataatttgacaaatagctataataggaacactccctatcaccaacatattttggttagtatattccttcatattaaaatgactttttgtcagttgttttgcattaaaaatatggcatgcctaagataaaattgtatattttttccatctcataaatattcattttcttcaaagtcttttttcaatctcataaaaaagggatagtgcatcttttaaaatacattttatttggggaggaacatgtggctgagcagacttttgtataatattacttcaaagatatgtaatcacaaacaaaaaaaactattttttataatgtcatttgagagagtttcatcagtacagttggtggacgttaattgtttgaatttgatagtctttgaatttaatcaagaaactacctggaaccagtgaaaaggaaagctggacttaaataatcttagaattaattgataaatgtctcttttaaaatctactgtatttattataatttacacccttgaaggtgatctcttgttttgtgttgtaaatatattgtttgtatgtttcccttcttgccttctgttataagtctcttcctttctcaaataaagttttttttaaaagaaaaaaaaaaaaaaaaaaaa

SEQ ID NO: 139 - DNA, 4122 bp, Artificial Sequence
  HDAC9
ctccacttaacttctgccttgtggaaggggtggggaagcctttatcaatgggtaggtgggagaaccaggggaagactgtcagctacgattttctctagcctcaagaagactgagaccgagccaaactcctggccaacgtgctttgtggattcacagtgtagcttgagaaaaatgtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctgggctgcccaccacacatcattggatcaaagctctccaccccttagtggaacatctccatcctacaagtacacattaccaggagcacaagatgcaaaggatgatttcccccttcgaaaaactgaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattagtttttgattttttgcaacatctagaatttaattttcacatcactgtacataatgtatcatactatagtcttgaacactgttaaaggtagtctgccccttccttcctctctctttttttagttaagtagaaatgttctggtcaccatgccagtagtcctaggttattgtgtaggttgcaattgaacatattaggaatacaggtggttttaaatatatagatgcaaattgcagcactactttaaatattagattatgtctcacatagcactgctcattttacttttattttgtgtaatttgatgacactgtctatcaaaaaagagcaaatgaagcagatgcaaatgttagtgagaagtaatgtgcagcattatggtccaatcagatacaatattgtgtctacaattgcaaaaaacacagtaacaggatgaatattatctgatatcaagtcaaaatcagtttgaaaagaaggtgtatcatattttatattgtcactagaatctcttaagtataattccataatgacatgggcatataccgtaacattctggcaaataacaattagaaaagataggtttaacaaaaaaatttacttgtatataatgcaccttcaggaggactatgtcctttgatgctataaaatacaaacaactttgaaggcaacagaagacactgtttattcaagtcagttctttgtcaggttcctgctgttctcctacagaaaagtgattctgtgagggtgaacaggaaatgccttgtggaaacaggaagtccaagtgattcatgtactgaggaatgtaggaaaaaaaatctgaggatagtgctttactctttctgtttttaaagggcactctatgaattgatttattgtctaagaaaataacaccacaagtagggaaattgttacggaagcttttcactggaacatttccttcatattcccttttgatatgtttaccttgttttataggtttacttttgttaagctagttaaaggttcgttgtattaagacccctttaatatggataatccaaattgacctagaatctttgtgaggttttttctattaaaatatttatatttctaaatccgaggtatttcaaggtgtagtatcctatttcaaaggagatatagcagttttgccaaatgtagacattgttcaactgtatgttattggcacgtgttgtttacattttgctgtgacatttaaaaatatttctttaaaaatgttactgctaaagatacattatccttttttaaaaagtctccattcaaattaaattaacataactagaagttagaaagtttaaaagttttccacataatgaaagtccttctgataatttgacaaatagctataataggaacactccctatcaccaacatattttggttagtatattccttcatattaaaatgactttttgtcagttgttttgcattaaaaatatggcatgcctaagataaaattgtatattttttccatctcataaatattcattttcttcaaagtcttttttcaatctcataaaaaagggatagtgcatcttttaaaatacattttatttggggaggaacatgtggctgagcagacttttgtataatattacttcaaagatatgtaatcacaaacaaaaaaaactattttttataatgtcatttgagagagtttcatcagtacagttggtggacgttaattgtttgaatttgatagtctttgaatttaatcaagaaactacctggaaccagtgaaaaggaaagctggacttaaataatcttagaattaattgataaatgtctcttttaaaatctactgtatttattataatttacacccttgaaggtgatctcttgttttgtgttgtaaatatattgtttgtatgtttcccttcttgccttctgttataagtctcttcctttctcaaataaagttttttttaaaagaaaaaaaaaaaaaaaaaaaa

SEQ ID NO: 140 - DNA, 4269 bp, Artificial Sequence
  HDAC9
ctccacttaacttctgccttgtggaaggggtggggaagcctttatcaatgggtaggtgggagaaccaggggaagactgtcagctacgattttctctagcctcaagaagactgagaccgagccaaactcctggccaacgtgctttgtggattcacagtgtagcttgagaaaaatgtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaagttgcaacaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgcctctgagcccaacttgaaggtgcggtccaggttaaaacagaaagtggcagagaggagaagcagccccttactcaggcggaaggatggaaatgttgtcacttcattcaagaagcgaatgtttgaggtgacagaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattagtttttgattttttgcaacatctagaatttaattttcacatcactgtacataatgtatcatactatagtcttgaacactgttaaaggtagtctgccccttccttcctctctctttttttagttaagtagaaatgttctggtcaccatgccagtagtcctaggttattgtgtaggttgcaattgaacatattaggaatacaggtggttttaaatatatagatgcaaattgcagcactactttaaatattagattatgtctcacatagcactgctcattttacttttattttgtgtaatttgatgacactgtctatcaaaaaagagcaaatgaagcagatgcaaatgttagtgagaagtaatgtgcagcattatggtccaatcagatacaatattgtgtctacaattgcaaaaaacacagtaacaggatgaatattatctgatatcaagtcaaaatcagtttgaaaagaaggtgtatcatattttatattgtcactagaatctcttaagtataattccataatgacatgggcatataccgtaacattctggcaaataacaattagaaaagataggtttaacaaaaaaatttacttgtatataatgcaccttcaggaggactatgtcctttgatgctataaaatacaaacaactttgaaggcaacagaagacactgtttattcaagtcagttctttgtcaggttcctgctgttctcctacagaaaagtgattctgtgagggtgaacaggaaatgccttgtggaaacaggaagtccaagtgattcatgtactgaggaatgtaggaaaaaaaatctgaggatagtgctttactctttctgtttttaaagggcactctatgaattgatttattgtctaagaaaataacaccacaagtagggaaattgttacggaagcttttcactggaacatttccttcatattcccttttgatatgtttaccttgttttataggtttacttttgttaagctagttaaaggttcgttgtattaagacccctttaatatggataatccaaattgacctagaatctttgtgaggttttttctattaaaatatttatatttctaaatccgaggtatttcaaggtgtagtatcctatttcaaaggagatatagcagttttgccaaatgtagacattgttcaactgtatgttattggcacgtgttgtttacattttgctgtgacatttaaaaatatttctttaaaaatgttactgctaaagatacattatccttttttaaaaagtctccattcaaattaaattaacataactagaagttagaaagtttaaaagttttccacataatgaaagtccttctgataatttgacaaatagctataataggaacactccctatcaccaacatattttggttagtatattccttcatattaaaatgactttttgtcagttgttttgcattaaaaatatggcatgcctaagataaaattgtatattttttccatctcataaatattcattttcttcaaagtcttttttcaatctcataaaaaagggatagtgcatcttttaaaatacattttatttggggaggaacatgtggctgagcagacttttgtataatattacttcaaagatatgtaatcacaaacaaaaaaaactattttttataatgtcatttgagagagtttcatcagtacagttggtggacgttaattgtttgaatttgatagtctttgaatttaatcaagaaactacctggaaccagtgaaaaggaaagctggacttaaataatcttagaattaattgataaatgtctcttttaaaatctactgtatttattataatttacacccttgaaggtgatctcttgttttgtgttgtaaatatattgtttgtatgtttcccttcttgccttctgttataagtctcttcctttctcaaataaagttttttttaaaagaaaaaaaaaaaaaaaaaaaa

SEQ ID NO: 141 - protein, 588 aa, Artificial Sequence
  HDAC9
MMSSPAQPDLMWNLVPWVLFCGCCRIFPDGVAGREQLLAQQRMHSMISSVDVKSEVPVGLEPISPLDLRTDLRMMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 142 - protein, 546 aa, Artificial Sequence
  HDAC9
MHSMISSVDVKSEVPVGLEPISPLDLRTDLRMMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 143 - protein, 549 aa, Artificial Sequence
  HDAC9
MHSMISSVDVKSEVPVGLEPISPLDLRTDLRMMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 144 - protein, 513 aa, Artificial Sequence
  HDAC9
MMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWAAHHTSLDQSSPPLSGTSPSYKYTLPGAQDAKDDFPLRKTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 145 - protein, 562 aa, Artificial Sequence
  HDAC9
MMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 146 - protein, 1044 aa, Artificial Sequence
  HDAC9
MMSSPAQPDGVAGREQLLAQQRMHSMISSVDVKSEVPVGLEPISPLDLRTDLRMMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQPFLEPTHTRALSVRQAPLAAVGMDGLEKHRLVSRTHSSPAASVLPHPAMDRPLQPGSATGIAYDPLMLKHQCVCGNSTTHPEHAGRIQSIWSRLQETGLLNKCERIQGRKASLEEIQLVHSEHHSLLYGTNPLDGQKLDPRILLGDDSQKFFSSLPCGGLGVDSDTIWNELHSSGAARMAVGCVIELASKVASGELKNGFAVVRPPGHHAEESTAMGFCFFNSVAITAKYLRDQLNISKILIVDLDVHHGNGTQQAFYADPSILYISLHRYDEGNFFPGSGAPNEVGTGLGEGYNINIAWTGGLDPPMGDVEYLEAFRTIVKPVAKEFDPDMVLVSAGFDALEGHTPPLGGYKVTAKCFGHLTKQLMTLADGRVVLALEGGHDLTAICDASEACVNALLGNELEPLAEDILHQSPNMNAVISLQKIIEIQSKYWKSVRMVAVPRGCALAGAQLQEETETVSALASLTVDVEQPFAQEDSRTAGEPMEEEPAL

SEQ ID NO: 147 - protein, 615 aa, Artificial Sequence
  HDAC9
MMSSPAQPDGVAGREQLLAQQRMHSMISSVDVKSEVPVGLEPISPLDLRTDLRMMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 148 - protein, 612 aa, Artificial Sequence
  HDAC9
MMSSPAQPDGVAGREQLLAQQRMHSMISSVDVKSEVPVGLEPISPLDLRTDLRMMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 149 - protein, 573 aa, Artificial Sequence
  HDAC9
MMSSPAQPDGVAGREQLLAQQRMHSMISSVDVKSEVPVGLEPISPLDLRTDLRMMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRESKRHQGAVASTEVKQKLQEFLLSKSATKDTPTNGKNHSVSRHPKLWYTAAHHTSLDQSSPPLSGTSPSYKYTLPGAQDAKDDFPLRKTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 150 - protein, 571 aa, Artificial Sequence
  HDAC9
MMSSPAQPDGVAGREQLLAQQRMHSMISSVDVKSEVPVGLEPISPLDLRTDLRMMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 151 - protein, 569 aa, Artificial Sequence
  HDAC9
MMSSPAQPDGVAGREQLLAQQRMHSMISSVDVKSEVPVGLEPISPLDLRTDLRMMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRERAVASTEVKQKLQEFLLSKSATKDTPTNGKNHSVSRHPKLWAAHHTSLDQSSPPLSGTSPSYKYTLPGAQDAKDDFPLRKTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 152 - protein, 593 aa, Artificial Sequence
  HDAC9
MHSMISSVDVKSEVPVGLEPISPLDLRTDLRMMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 153 - protein, 595 aa, Artificial Sequence
  HDAC9
MHSMISSVDVKSEVPVGLEPISPLDLRTDLRMMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRESKRHQGAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 154 - protein, 506 aa, Artificial Sequence
  HDAC9
MHSMISSVDVKSEVPVGLEPISPLDLRTDLRMMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRERAVASTEVKQKLQEFLLSKSATKDTPTNGKNHSVSRHPKLWAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKICHDEEIPFPSSASQLHTH

SEQ ID NO: 155 - protein, 1025 aa, Artificial Sequence
  HDAC9
MHSMISSVDVKSEVPVGLEPISPLDLRTDLRMMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQPFLEPTHTRALSVRQAPLAAVGMDGLEKHRLVSRTHSSPAASVLPHPAMDRPLQPGSATGIAYDPLMLKHQCVCGNSTTHPEHAGRIQSIWSRLQETGLLNKCERIQGRKASLEEIQLVHSEHHSLLYGTNPLDGQKLDPRILLGDDSQKFFSSLPCGGLGVDSDTIWNELHSSGAARMAVGCVIELASKVASGELKNGFAVVRPPGHHAEESTAMGFCFFNSVAITAKYLRDQLNISKILIVDLDVHHGNGTQQAFYADPSILYISLHRYDEGNFFPGSGAPNEVGTGLGEGYNINIAWTGGLDPPMGDVEYLEAFRTIVKPVAKEFDPDMVLVSAGFDALEGHTPPLGGYKVTAKCFGHLTKQLMTLADGRVVLALEGGHDLTAICDASEACVNALLGNELEPLAEDILHQSPNMNAVISLQKIIEIQSKYWKSVRMVAVPRGCALAGAQLQEETETVSALASLTVDVEQPFAQEDSRTAGEPMEEEPAL

SEQ ID NO: 156 - protein, 654 aa, Artificial Sequence
  HDAC9
MHSMISSVDVKSEVPVGLEPISPLDLRTDLRMMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKRTTVPLSPRAHLHSLRVHLLDKSILTGAPATLAPSLIFEESPSTSRSCASHYFVWKAQPPRLLTLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 157 - protein, 547 aa, Artificial Sequence
  HDAC9
MHSMISSVDVKSEVPVGLEPISPLDLRTDLRMMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRERAVASTEVKQKLQEFLLSKSATKDTPTNGKNHSVSRHPKLWAAHHTSLDQSSPPLSGTSPSYKYTLPGAQDAKDDFPLRKTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 158 - protein, 591 aa, Artificial Sequence
  HDAC9
MHSMISSVDVKSEVPVGLEPISPLDLRTDLRMMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRERAVASTEVKQKLQEFLLSKSATKDTPTNGKNHSVSRHPKLWAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 159 - protein, 554 aa, Artificial Sequence
  HDAC9
MHSMISSVDVKSEVPVGLEPISPLDLRTDLRMMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRESKRHQGAVASTEVKQKLQEFLLSKSATKDTPTNGKNHSVSRHPKLWYTAAHHTSLDQSSPPLSGTSPSYKYTLPGAQDAKDDFPLRKTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 160 - protein, 559 aa, Artificial Sequence
  HDAC9
MMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 161 - protein, 560 aa, Artificial Sequence
  HDAC9
MMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRERAVASTEVKQKLQEFLLSKSATKDTPTNGKNHSVSRHPKLWAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 162 - protein, 544 aa, Artificial Sequence
  HDAC9
MHSMISSVDVKSEVPVGLEPISPLDLRTDLRMMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWAAHHTSLDQSSPPLSGTSPSYKYTLPGAQDAKDDFPLRKTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 163 - protein, 516 aa, Artificial Sequence
  HDAC9
MMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRERAVASTEVKQKLQEFLLSKSATKDTPTNGKNHSVSRHPKLWAAHHTSLDQSSPPLSGTSPSYKYTLPGAQDAKDDFPLRKTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 164 - protein, 588 aa, Artificial Sequence
  HDAC9
MHSMISSVDVKSEVPVGLEPISPLDLRTDLRMMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 165 - protein, 546 aa, Artificial Sequence; identical to SEQ ID NO: 142
  HDAC9

SEQ ID NO: 166 - protein, 546 aa, Artificial Sequence; identical to SEQ ID NO: 142
  HDAC9

SEQ ID NO: 167 - protein, 549 aa, Artificial Sequence; identical to SEQ ID NO: 143
  HDAC9

SEQ ID NO: 168 - protein, 549 aa, Artificial Sequence; identical to SEQ ID NO: 143
  HDAC9

SEQ ID NO: 169 - protein, 682 aa, Artificial Sequence
  HDAC9
MHSMISSVDVKSEVPVGLEPISPLDLRTDLRMMMPVVDPVVREKQLQQELLLIQQQQQIQKQLLIAEFQKQHENLTRQHQAQLQEHIKLQQELLAIKQQQELLEKEQKLEQQRQEQEVERMMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 170 - protein, 1025 aa, Artificial Sequence; identical to SEQ ID NO: 155
  HDAC9

SEQ ID NO: 171 - protein, 554 aa, Artificial Sequence; identical to SEQ ID NO: 159
  HDAC9

SEQ ID NO: 172 - protein, 593 aa, Artificial Sequence; identical to SEQ ID NO: 152
  HDAC9

SEQ ID NO: 173 - protein, 590 aa, Artificial Sequence
  HDAC9
MHSMISSVDVKSEVPVGLEPISPLDLRTDLRMMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 174 - protein, 591 aa, Artificial Sequence; identical to SEQ ID NO: 158
  HDAC9

SEQ ID NO: 175 - protein, 593 aa, Artificial Sequence; identical to SEQ ID NO: 152
  HDAC9

SEQ ID NO: 176 - protein, 590 aa, Artificial Sequence; identical to SEQ ID NO: 173
  HDAC9

SEQ ID NO: 177 - protein, 1011 aa, Artificial Sequence
  HDAC9
MHSMISSVDVKSEVPVGLEPISPLDLRTDLRMMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQPFLEPTHTRALSVRQAPLAAVGMDGLEKHRLVSRTHSSPAASVLPHPAMDRPLQPGSATGIAYDPLMLKHQCVCGNSTTHPEHAGRIQSIWSRLQETGLLNKCERIQGRKASLEEIQLVHSEHHSLLYGTNPLDGQKLDPRILLGDDSQKFFSSLPCGGLGVDSDTIWNELHSSGAARMAVGCVIELASKVASGELKNGFAVVRPPGHHAEESTAMGFCFFNSVAITAKYLRDQLNISKILIVDLDVHHGNGTQQAFYADPSILYISLHRYDEGNFFPGSGAPNEVGTGLGEGYNINIAWTGGLDPPMGDVEYLEAFRTIVKPVAKEFDPDMVLVSAGFDALEGHTPPLGGYKVTAKCFGHLTKQLMTLADGRVVLALEGGHDLTAICDASEACVNALLGNELEPLAEDILHQSPNMNAVISLQKIIEIQSMSLKFS

SEQ ID NO: 178 - protein, 1066 aa, Artificial Sequence
  HDAC9
MHSMISSVDVKSEVPVGLEPISPLDLRTDLRMMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQPFLEPTHTRALSVRQAPLAAVGMDGLEKHRLVSRTHSSPAASVLPHPAMDRPLQPGSATGIAYDPLMLKHQCVCGNSTTHPEHAGRIQSIWSRLQETGLLNKCERIQGRKASLEEIQLVHSEHHSLLYGTNPLDGQKLDPRILLGDDSQKFFSSLPCGGLGVDSDTIWNELHSSGAARMAVGCVIELASKVASGELKNGFAVVRPPGHHAEESTAMGFCFFNSVAITAKYLRDQLNISKILIVDLDVHHGNGTQQAFYADPSILYISLHRYDEGNFFPGSGAPNEVGTGLGEGYNINIAWTGGLDPPMGDVEYLEAFRTIVKPVAKEFDPDMVLVSAGFDALEGHTPPLGGYKVTAKCFGHLTKQLMTLADGRVVLALEGGHDLTAICDASEACVNALLGNELEPLAEDILHQSPNMNAVISLQKIIEIQSKYWKSVRMVAVPRGCALAGAQLQEETETVSALASLTVDVEQPFAQEDSRTAGEPMEEEPAL

SEQ ID NO: 179 - protein, 1069 aa, Artificial Sequence
  HDAC9
MHSMISSVDVKSEVPVGLEPISPLDLRTDLRMMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQPFLEPTHTRALSVRQAPLAAVGMDGLEKHRLVSRTHSSPAASVLPHPAMDRPLQPGSATGIAYDPLMLKHQCVCGNSTTHPEHAGRIQSIWSRLQETGLLNKCERIQGRKASLEEIQLVHSEHHSLLYGTNPLDGQKLDPRILLGDDSQKFFSSLPCGGLGVDSDTIWNELHSSGAARMAVGCVIELASKVASGELKNGFAVVRPPGHHAEESTAMGFCFFNSVAITAKYLRDQLNISKILIVDLDVHHGNGTQQAFYADPSILYISLHRYDEGNFFPGSGAPNEVGTGLGEGYNINIAWTGGLDPPMGDVEYLEAFRTIVKPVAKEFDPDMVLVSAGFDALEGHTPPLGGYKVTAKCFGHLTKQLMTLADGRVVLALEGGHDLTAICDASEACVNALLGNELEPLAEDILHQSPNMNAVISLQKIIEIQSKYWKSVRMVAVPRGCALAGAQLQEETETVSALASLTVDVEQPFAQEDSRTAGEPMEEEPAL

SEQ ID NO: 180 - DNA, 5397 bp, Artificial Sequence
  KCNJ2
gcgcactggagccctggccagcgcgcagccttcccggcgccggcgggctgggtcttgggaattctggtttgctttggctcactcgctttttacaaaccactggatcttacatgcctctgtaccccccacttccactccatgtccccatgctcctgcgccagcaacaggacatgttctctggatgtcagctgagtcattaaagtaactctgcatgtcagtagacagaccttggtagaaccacaaggctcccagagacacccatctctcctcatttttttggtgtgtgtgtcttcaccgaacattcaaaactgtttctccaaagcgttttgcaaaaactcagactgttttccaaagcagaagcactggagtccccagcagaagcgatgggcagtgtgcgaaccaaccgctacagcatcgtctcttcagaagaagacggtatgaagttggccaccatggcagttgcaaatggctttgggaacgggaagagtaaagtccacacccgacaacagtgcaggagccgctttgtgaagaaagatggccactgtaatgttcagttcatcaatgtgggtgagaaggggcaacggtacctcgcagacatcttcaccacgtgtgtggacattcgctggcggtggatgctggttatcttctgcctggctttcgtcctgtcatggctgttttttggctgtgtgttttggttgatagctctgctccatggggacctggatgcatccaaagagggcaaagcttgtgtgtccgaggtcaacagcttcacggctgccttcctcttctccattgagacccagacaaccataggctatggtttcagatgtgtcacggatgaatgcccaattgctgttttcatggtggtgttccagtcaatcgtgggctgcatcatcgatgctttcatcattggcgcagtcatggccaagatggcaaagccaaagaagagaaacgagactcttgtcttcagtcacaatgccgtgattgccatgagagacggcaagctgtgtttgatgtggcgagtgggcaatcttcggaaaagccacttggtggaagctcatgttcgagcacagctcctcaaatccagaattacttctgaaggggagtatatccctctggatcaaatagacatcaatgttgggtttgacagtggaatcgatcgtatatttctggtgtccccaatcactatagtccatgaaatagatgaagacagtcctttatatgatttgagtaaacaggacattgacaacgcagactttgaaatcgtggtcatactggaaggcatggtggaagccactgccatgacgacacagtgccgtagctcttatctagcaaatgaaatcctgtggggccaccgctatgagcctgtgctctttgaagagaagcactactacaaagtggactattccaggttccacaaaacttacgaagtccccaacactcccctttgtagtgccagagacttagcagaaaagaaatatatcctctcaaatgcaaattcattttgctatgaaaatgaagttgccctcacaagcaaagaggaagacgacagtgaaaatggagttccagaaagcactagtacggacacgccccctgacatagaccttcacaaccaggcaagtgtacctctagagcccaggcccttacggcgagagtcggagatatgactgactgattccttctctggaatagttactttacaacacggtctgttggtcagaggcccaaaacagttatacagatgacggtactggtcaagatgggtcaagcaagcggccacaagggactgaggcaagcacaatggtttcaaagaaagactgtaagctccatgattagcataaagcactaaccatgtctccatgtgacccgatggcacatagatgttgtagaataagttatgggtttttatgttttgttttgtgtttttccaaaacttgaacttgcaggcaagccttggttgggtatttgatttatccagaatgcttctctttagggaacaaggatgtttttaatggcataacaaaggcaagactctgccttaatttttgaaaagctgctaactacatgaacacaaatgtgtatttttgttgcagtgtagttttccttttgtgtaattttaaagtcagtgttgaattttattgaaagctcatgatgcgcttcaaagtggcaagtatttggctattaactgccaaaacaagagcctgattttttgaggccagtaattcgtttgctagaattgattttttttctctctctctttgttacataagggcattatgtaacactagccgaatggtagcctctgggttgttgtttttttcttttcctccatgatgttaatgggttatctcaaattttaagttaaactacctaaaataaataccaaagataatgcatatttttgcacagtggagcttacacttaaaagaaaacaaagccccatgggctgccttgaaatcaagagacaataactttgaacctcagcaagaccttgaaccgccggttcattttgcaccttattcagaaaatagagcatcatactcaccgagtctagtcagtgtagtgcttttaaaaattttgtcctttcatgtaacttttttattttaagaggaagaagaagaaaggggcacacacacacaataccgacgtctatcctttcctgctaggcagtgctggccaggctcatgtgtagtgtgcgagatggtgatgtactcttatatttttctgggcttttccttttgcacattccaaaattcatttcataagacaagatcttcataggacctccttggcatcctggcattctcaaaactgagccatccagcatgaaagataaatgggtttaaacccttgctgctgaatttattgcctggactgtcaggacatcaccagcccaccttcaccttagggaagatgccacacctggcctccacacttgctcttctgatcagtctgtctggattgagtcctacagtgtcagatagggcggcaaatgccaaagcagggaaacagggaggtgtggacaagccagtttgatgcagcacttcagatcaagtgcttaggaaggagaggaaacttgccttttttatggcagaggatagtaatgaaaatgtctcagtattttagggtcaatgagagccataaaaatataacataatcacaagtaaaggagataatggtctaaaacagctatttcccttttctgtgtgcatacttatgactgaatgtgagctaagcattttctcctgtggagccctagagcaggttactaaggaaggacacattgttttccagaagcctcccctgcctggctgactgccttgctagaaacataattttttttttctcactgaagctcaataatggaactctttttttttttttttttaatttaaagttccctatttgtgaattctgggattactgacttttctttttaattggagtctcaaaatcaactctcttatggtattatatctctgtatgccattaaaaaacagcttgttctagaatcatgtattttgtaaactgatgtttgtgatggtctctggttcttgaacagccatatctgaatgccgtgcctgcaaaactatgacaatttttgctgttttcagccttcagatttgatggcttgggaaactgaggtgttattttcaatgaaacaaagaaagagatgttaagcaagtggttgttttagatccaaatgtaaaggcaggtttgggaaggtgtttaaagagttggaggaattggggattgagttgtaaagaaaacttacagaagaggcaacaatttggttcttgacagtgagaggatattgagggcttcagctgctgctattatgatgttttgcaaaggaaaataatcaaaccaaagagtattcagtgatatgtaaattaaatgaagatacagtggagaatgggggtgaccacaaaagaggctccccctaaacacacagtgctgccacttaaaaagacttgagaaatttgaaagggggtgggtatggggggggcaagaaagagggagggaaatctttcaacttatttctgaaaaagagaaaaaaatataaaatttctggtgcacaggtttgttttttcaagaaaattttgcagaagctatgtttttaaagtgtacattttataaagtttatcagatattttcatatttaaagccaaatgtaaatagaggtctgtaaagaaaaataattgccatagaaagtataatttcagtgcagtaatttctgagagctagtacctatatgctaccggttagcatggttttagcaaatatataccagccttataaggttcgtattgctatgttcttctgttatttatttcagcatggactgttcatttgaaacctttttctagttattagcgttttaacagttacaagctttaaatggcaattttttttttttttttttttttttttttttttttgtcaagagccaagacacaggtaatgcacgacattgattgctgcattttaccttcaaaatatttgtccttattgactgggtctccttaattaatgtacacatgtcattagaatgcagacggaggggactcaccatgaatatctggggttgattcccagatgtgtgttgcttctctattgcaagcagattccctgttggatttacttcggatttattcccttttaaagaatttttgcccatatctggaagggcactatatttttgggaggagccatagattcctggttatcctatttttaaacaaaatgtagacaaagtgaactctattttgattattgagaaaggagtagttttctatccctctaagagtatacttgaatcagacattttaaggatgtcactatggcactgttgtcatttccaaattcctagaaaagtttgttttactttgtttttattctgttaatgcattctttcttctctttacttcctttcttaccagtacactcctatctcaactctgtttatttgatgagttctgtcccgtaaatcatatttcccttacaattaataaatgtcacttcatattttataataaaccactcagtaaaagcaaaagcttgtcctgagaagtagagtgagttctttttcactctgtgtctaataatgttaaggtgggaaaaaaaaaagtgtggcatagctacctgcccatccccaaccctcagcaaagtagaatctcttttctggtaattttgggtttccgctctgggctctggcaagttgaacaatcctagccattgacaatcgtgatagttattattttcccatttgctgtctttttgtatctaaagtcttcctattgtactgcacaaaccatggattgtacatatttttatatattatgtcttattttattatttctaaataaaaaaattaaaaattgaaaaaaaaaaaaa

SEQ ID NO: 181 - protein, 427 aa, Artificial Sequence
  KCNJ2
MGSVRTNRYSIVSSEEDGMKLATMAVANGFGNGKSKVHTRQQCRSRFVKKDGHCNVQFINVGEKGQRYLADIFTTCVDIRWRWMLVIFCLAFVLSWLFFGCVFWLIALLHGDLDASKEGKACVSEVNSFTAAFLFSIETQTTIGYGFRCVTDECPIAVFMVVFQSIVGCIIDAFIIGAVMAKMAKPKKRNETLVFSHNAVIAMRDGKLCLMWRVGNLRKSHLVEAHVRAQLLKSRITSEGEYIPLDQIDINVGFDSGIDRIFLVSPITIVHEIDEDSPLYDLSKQDIDNADFEIVVILEGMVEATAMTTQCRSSYLANEILWGHRYEPVLFEEKHYYKVDYSRFHKTYEVPNTPLCSARDLAEKKYILSNANSFCYENEVALTSKEEDDSENGVPESTSTDTPPDIDLHNQASVPLEPRPLRRESEI

SEQ ID NO: 182 - DNA, 2108 bp, Artificial Sequence
  CD36
ctttcaattcctctggcaacaaaccacacactgggatctgacactgtagagtgctttctcttctctttttttgggggggggagggggtgtggttgcatatttaaactctcacgcatttatgtactgaggactgcagtgtaggactttcctgcagaataccatttgatcctattaagaattgtccaaatgttggagcatttgattgaaaaatccttcttagccattttaaagatagctttccaatgattagacgaattgattctttctgtgactcatcagttcatttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaagttgtccaaaaaa

SEQ ID NO: 183 - DNA, 2069 bp, Artificial Sequence
  CD36
gaggatgtcaatggctttcagatgtcaggataaccttaaggatagatgaagggttgagagcctgtgcctcatttctgagttctcagctgctatgccgtggaaatcctgtttactttctgcatctgctcctgcaagactctggagccagtcttgaggtcctacatctccgaaagcaagctcttctagaagttgatagctttccaatgattagacgaattgattctttctgtgactcatcagttcatttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaagttgtccaaaaaa

SEQ ID NO: 184 - DNA, 4727 bp, Artificial Sequence
  CD36
ctttcaattcctctggcaacaaaccacacactgggatctgacactgtagagtgctttctcttctctttttttgggggggggagggggtgtggttgcatatttaaactctcacgcatttatgtactgaggactgcagtgtaggactttcctgcagaataccatttgatcctattaagaattgtccaaatgttggagcatttgattgaaaaatccttcttagccattttaaagatagctttccaatgattagacgaattgattctttctgtgactcatcagttcatttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataaacctggctcaagcacaaaccaatttgtgttgttctgattcaataattggtttctgggtggccaattcagaagaagagtgtacatgctcaacaaatcctaggccctgcattcctgtcatcctcatccgggggaaacaccatcatcccagtagctgccctattcaactgcaacagtctccaggaccatcagtatactgcatttcatgtgcaccaaatattttgaaagacatttataaataattggcttatgactcatatttctctatgaataccttcatacagcaggtataactcttttctttatgggcttaaatattttgtcactgatcctgcaaatggacatcattttagcacactagcggtttatattttaaggaccttcattctctgttctgcacctcttctggaaattgagtaaattttgcttttttttttttactcagttgcaacttacgcttggcatcttcagaatgcttttctagcattaagagatgtaaatgataaaggaattattgtatgaaatattacaaagcgtagactatgcattgttattcattataatattttttgctgtcataatcgcctcataaagacaggtttcaaccattaaaatatgttcttccttaaattcctgtgctttttctagttcctcttgtgtcataaaatgtttatcctaattttctctctgaagtatattttatctgaatccacatttctttataaatccatagtccttgctgaaatatgctttctaaatttctaccactttgttctaggctaattttttaagctaattggatgaagaacaaaaagacatttggtttcatcctttacagcagtaggacaattgcaaaggtttttcctttttcataaggagacacattaataggtaactctgtttcttgagcaggggttcacttattctgagagcattagttctcctaaaaagctccagcatagaaagggaagataaaccaaattctagcttgtgttttacccacagaaggatacaggacaaaggaatagtaactggcctgtttggatactaaaatcgaaaataacttttagcctcctccttatgatagccgccagagtaaatgttgagcattactacagaaaagccacaaaccaagaatctacctgtttggaaagatcttttgcatctctgaaggtgcttaaagcatacttagtgcctttccttttaactgggaagataaaagaagtatctgtccaagatattaatatgtaagataacattgtagacatgttcttctgataatacaaggtttattctatttgcattaggatatttgtggacatgtccatctaatataaaggaaagttttttaatcattgaggcatgtagggctgagttatataatgtagaaacttctaaagataattggatgagaatatacatattgacctgtatattatgactaatcatgactcagatcttaatacagggatgatctcatagcatttagatatcagaaaaggttttgacctatatgtctttaatattgtttgaatacatgtataatctttatcattcctcagtgtttcatttctcaaattctgtaaaaggaatataagaggaaagacaattcatatacaaagacaacgagattaaaaatatgcagtaggaaaaataattacttaaggggagattttttttacatgaaatctgggctttggatgtgtgtgtgtgtgtgtgtgtgtgtgtgtgtgcacatatgcactgtggtgggagtggggcaacttggggaatatgttacatgtgtgactttgttttgccctggcgaagttaatgttgttcagaaagggtaaatgtttggacacttgcaattgctcatggatgaatttatatgttttagtcatagaaaaattgtaccctttgatagaagcacattttctttccaaagctggttattaaccacagaattatagcaggtattcataacttaagtttgaaaatcaatagcgtctgcaaatggattaacagattagagaatcaacagcatcggaaaataggttaatgcatattgcttctaacaagtgcatgaagaaatagaagaagctatgtagctttcagttctgacagaaaagggtgaaggagggtatcatttcaagaaaaaaaatagctatcacgcaatggttatctctgaaaatatttgtattaagatgtgtatacatggccaggcatggtggctcatgcctgtaatcccagcactttgggaggcaggtggatcacgaggtcaggagatcaagaccatcctggccaacatggtgaaacctcatctctactaaaaatacaaaaatgagcggggtgtggtggcccatgcctgtagtcccagctgctcgggagactgaatctcttgagcctgggaagcagaggttgcagtgaactgagatcgcgtcactgcactccagcctggtgacagagcgagattccatctcaaaaaaaaaaaacagtatgcacgtacaaatttcttaacctgttatcaatgtctgagctacataattatctttctagttggagtttgttttaggtgtgtaccaactgacatttcagtttttctgtttgaagtccaatgtattagtgactctgtggctgctctcttcacctgccccttgtggcctgtctacaattctaaatggattttgaactcaatgtcgtcgcttctggtttcctgcatataccaatagcattacctatgactttttttttcctgagctattttcactgagctgagctaatgaactaaaactgagttatgtttaatatttgtatcaaatacataaaaggaatactgctttttccttttgtggctcaaaggtagctgcattttaaaatatttgtgaaaataaaaacttttgttattagaaaaatga

SEQ ID NO: 185 - DNA, 1814 bp, Artificial Sequence
  CD36
aagttgctgagacaagggaagagagatgaggaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaagttgtccaaaaaa

SEQ ID NO: 186 - DNA, 1989 bp, Artificial Sequence
  CD36
atgacattattagttctgccactggtaggcattagaagcaagaaaagggagacggaccgaggaagccactttggtgaaacaaaaagaaaagcatttgtttatttagaacgggcaaaatgatacgtttcagtgggtgttttctttgtactttgatctttttgtactgatatttaagcttctgttttatgatctctttctaatgatagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaagttgtccaaaaaa

SEQ ID NO: 187 - DNA, 1665 bp, Artificial Sequence
  CD36
accagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaagttgtccaaaaaa

SEQ ID NO: 188 - DNA, 1693 bp, Artificial Sequence
  CD36
ctttccaatgattagacgaattgattctttctgtgactcatcagttcatttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcatacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaagttgtccaaaaaa

SEQ ID NO: 189 - DNA, 1747 bp, Artificial Sequence
  CD36
agatgtcaggataaccttaaggatagatgaagggttgagagcctgtgcctcatttctgagttctcagctgctatgccgtggaaatcctgtttactttctgcatctgctcctgcaagactctggagccagtcttgaggtcctacatctccgaaagcaagctcttctagaagttgcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaagttgtccaaaaaa

SEQ ID NO: 190 - protein, 472 aa, Artificial Sequence
  CD36
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVAAASHIYQNQFVQMILNSLINKSKSSMFQVRTLRELLWGYRDPFLSLVPYPVTTTVGLFYPYNNTADGVYKVFNGKDNISKVAIIDTYKGKRNLSYWESHCDMINGTDAASFPPFVEKSQVLQFFSSDICRSIYAVFESDVNLKGIPVYRFVLPSKAFASPVENPDNYCFCTEKIISKNCTSYGVLDISKCKEGRPVYISLPHFLYASPDVSEPIDGLNPNEEEHRTYLDIEPITGFTLQFAKRLQVNLLVKPSEKIQVLKNLKRNYIVPILWLNETGTIGDEKANMFRSQVTGKINLLGLIEMILLSVGVVMFVAFMISYCACRSKTIK

SEQ ID NO: 191 - protein, 472 aa, Artificial Sequence; identical to SEQ ID NO: 190
  CD36

SEQ ID NO: 192 - protein, 472 aa, Artificial Sequence; identical to SEQ ID NO: 190
  CD36

SEQ ID NO: 193 - protein, 472 aa, Artificial Sequence; identical to SEQ ID NO: 190
  CD36

SEQ ID NO: 194 - protein, 472 aa, Artificial Sequence; identical to SEQ ID NO: 190
  CD36

SEQ ID NO: 195 - protein, 472 aa, Artificial Sequence; identical to SEQ ID NO: 190
  CD36

SEQ ID NO: 196 - protein, 412 aa, Artificial Sequence
  CD36
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVAYNNTADGVYKVFNGKDNISKVAIIDTYKGKRNLSYWESHCDMINGTDAASFPPFVEKSQVLQFFSSDICRSIYAVFESDVNLKGIPVYRFVLPSKAFASPVENPDNYCFCTEKIISKNCTSYGVLDISKCKEGRPVYISLPHFLYASPDVSEPIDGLNPNEEEHRTYLDIEPITGFTLQFAKRLQVNLLVKPSEKIQVLKNLKRNYIVPILWLNETGTIGDEKANMFRSQVTGKINLLGLIEMILLSVGVVMFVAFMISYCACRSKTIK

SEQ ID NO: 197 - protein, 396 aa, Artificial Sequence
  CD36
MMNSSNIQVKQRGPYTYRVRFLAKENVTQDAEDNTVSFLQPNGAIFEPSLSVGTEADNFTVLNLAVAAASHIYQNQFVQMILNSLINKSKSSMFQVRTLRELLWGYRDPFLSLVPYPVTTTVGLFYPYNNTADGVYKVFNGKDNISKVAIIDTYKGKRNLSYWESHCDMINGTDAASFPPFVEKSQVLQFFSSDICRSIYAVFESDVNLKGIPVYRFVLPSKAFASPVENPDNYCFCTEKIISKNCTSYGVLDISKCKEGRPVYISLPHFLYASPDVSEPIDGLNPNEEEHRTYLDIEPITGFTLQFAKRLQVNLLVKPSEKIQVLKNLKRNYIVPILWLNETGTIGDEKANMFRSQVTGKINLLGLIEMILLSVGVVMFVAFMISYCACRSKTIK

SEQ ID NO: 198 - DNA, 838 bp, Artificial Sequence
  FABP4
gggtcacagcaccctcctgaaaactgcagcttccttctcaccttgaagaataatcctagaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaagtcactgcagatgacaggaaagtcaagagcaccataaccttagatgggggtgtcctggtacatgtgcagaaatgggatggaaaatcaaccaccataaagagaaaacgagaggatgataaactggtggtggaatgcgtcatgaaaggcgtcacttccacgagagtttatgagagagcataagccaagggacgttgacctggactgaagttcgcattgaactctacaacattctgtgggatatattgttcaaaaagatattgttgttttccatgatttagcaagcaactaattttctcccaagctgattttattcaatatggttacgttggttaaataaactttttttagatttagaaggtgatgtaatgatgtattcattgtgcttatgatgtattcttagtcataactgagtgaaggaaatgggaaatttgcattatttctttgttctgatatgaataataacatatttcataataattcaaggtaaaaagggatatctatggatttccctaggtaggagataacaagtatgtaccattactgaatat

SEQ ID NO: 199 - protein, 132 aa, Artificial Sequence
  FABP4
MCDAFVGTWKLVSSENFDDYMKEVGVGFATRKVAGMAKPNMIISVNGDVITIKSESTFKNTEISFILGQEFDEVTADDRKVKSTITLDGGVLVHVQKWDGKSTTIKRKREDDKLVVECVMKGVTSTRVYERA

SEQ ID NO: 200 - DNA, 5093 bp, Artificial Sequence
  CD71
acgcacagcccccctgggggccgggggcggggccaggctataaaccgccggttaggggccgccatcccctcagagcgtcgggatatcgggtggcggctcgggacggaggacgcgctagtgttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccggcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaaaaaaa

SEQ ID NO: 201 - DNA, 4891 bp, Artificial Sequence
  CD71
acgcacagcccccctgggggccgggggcggggccaggctataaaccgccggttaggggccgccatcccctcagagcgtcgggatatcgggtggcggctcgggacggaggacgcgctagtgttcttctgtgtggcagttcagaatgatggatcaagctagatcagcattctctaacttggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccggcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaaaaaaa

SEQ ID NO: 202 - DNA, 4695 bp, Artificial Sequence
  CD71
acgcacagcccccctgggggccgggggcggggccaggctataaaccgccggttaggggccgccatcccctcagagcgtcgggatatcgggtggcggctcgggacggaggacgcgctagtgttcttctgtgtggcagttcagaatgatggatcaagctagatcagcattctctaacttggctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaaaaaaa

SEQ ID NO: 203 - DNA, 5234 bp, Artificial Sequence
  CD71
agagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccggcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaaaaaaa

SEQ ID NO: 204 - protein, 760 aa, Artificial Sequence
  CD71
MMDQARSAFSNLFGGEPLSYTRFSLARQVDGDNSHVEMKLAVDEEENADNNTKANVTKPKRCSGSICYGTIAVIVFFLIGFMIGYLGYCKGVEPKTECERLAGTESPVREEPGEDFPAARRLYWDDLKRKLSEKLDSTDFTGTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGQFLYQDSNWASKVEKLTLDNAAFPFLAYSGIPAVSFCFCEDTDYPYLGTTMDTYKELIERIPELNKVARAAAEVAGQFVIKLTHDVELNLDYERYNSQLLSFVRDLNQYRADIKEMGLSLQWLYSARGDFFRATSRLTTDFGNAEKTDRFVMKKLNDRVMRVEYHFLSPYVSPKESPFRHVFWGSGSHTLPALLENLKLRKQNNGAFNETLFRNQLALATWTIQGAANALSGDVWDIDNEF

SEQ ID NO: 205 - protein, 679 aa, Artificial Sequence
  CD71
MIGYLGYCKGVEPKTECERLAGTESPVREEPGEDFPAARRLYWDDLKRKLSEKLDSTDFTGTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGQFLYQDSNWASKVEKLTLDNAAFPFLAYSGIPAVSFCFCEDTDYPYLGTTMDTYKELIERIPELNKVARAAAEVAGQFVIKLTHDVELNLDYERYNSQLLSFVRDLNQYRADIKEMGLSLQWLYSARGDFFRATSRLTTDFGNAEKTDRFVMKKLNDRVMRVEYHFLSPYVSPKESPFRHVFWGSGSHTLPALLENLKLRKQNNGAFNETLFRNQLALATWTIQGAANALSGDVWDIDNEF

SEQ ID NO: 206 - protein, 478 aa, Artificial Sequence
  CD71
MDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGQFLYQDSNWASKVEKLTLDNAAFPFLAYSGIPAVSFCFCEDTDYPYLGTTMDTYKELIERIPELNKVARAAAEVAGQFVIKLTHDVELNLDYERYNSQLLSFVRDLNQYRADIKEMGLSLQWLYSARGDFFRATSRLTTDFGNAEKTDRFVMKKLNDRVMRVEYHFLSPYVSPKESPFRHVFWGSGSHTLPALLENLKLRKQNNGAFNETLFRNQLALATWTIQGAANALSGDVWDIDNEF

SEQ ID NO: 207 - protein, 760 aa, Artificial Sequence; identical to SEQ ID NO: 204
  CD71

SEQ ID NO: 208 - DNA, 4154 bp, Artificial Sequence
  CHST2
ggctggtccgagcgcgttgcgggcgcccggcgtaaggggagtcgggtagcagcatcctcctgggcgccgctttcgcgcggcggcggcggctgcggcggggtctttctttgcttaaatacctcgttggccagaagcgctggtaccgggggcgggttgggtcgggtcgggcagtgctgcacacctgggtttccttgcctagagctgtgtgttcggggtcctttggtccagtcggaggctgcggagcggcgggggttgcctgcgctgtccgcccgggcatcctcccggtgatggaagcagccgccgccgccgctgcggggtcgcgctgtgccccatccaccgctgccagagaggtgggaaaattcgccgcacggaggccgaaagcgagaggggctgcgccgctatgccgggagctgagtcccatataagccgcccccagccatcgcccccagccggcttcgttcccctgagcgagacaggaagctgcggtcccgagaaagcggaggagacgtcgctggagccgggaggcgccgggttcggcggagcgcggagcggggctctgggccgcgtgaaagtttttcttcccgagccgcagggcgcccgctgcccggaaactgcccagggataagtcggccgactccccagacccctcgaaggtgcggggacccccagcggaagcgagagggagcgaaatcgaggaacgagtgacagccggacagtccgccgggcggtgatccggggccgctcccgggcgcgccctcggctccaggtcctacccggagccgctgccatgggagagccagccttgggcgctggggaccagccgccgcgcccgcctcggagtcgcggcccgagtcccggcgccagcagccagcccgctgcgtccccttcccgggctgcagggctgcctccgccgcgccgccggcccggattgtgcctgtgatgagccgcagcccgcagcgagctctgcccccgggcgcgctccctcggctgctccaggctgcgcctgcagccgcgccgcgtgccctgctcccgcagtggccccggcgcccaggacgccgctggcccgcgtcccctctcggaatgaaggtgttccgtaggaaggcgctggtgttgtgcgcgggctatgcactgctgctggtgctcactatgctcaacctcctggactacaagtggcacaaggagccgctgcagcagtgcaaccccgatgggccgctgggtgccgcagcgggggcagccggaggcagctgggggcgcccagggccgcctccggccgggccgccccgtgctcatgcccgtttggacctccgcactccttaccgccctcccgctgccgccgtcggggcggctcctgcagccgcggcagggatggcgggggttgcggcccctccaggcaatggcactcggggcaccgggggcgtcggggacaagcggcagctggtgtacgtgttcaccacgtggcgctctggctcgtcgttcttcggcgagctattcaaccagaatcccgaggtgttctttctctacgagccagtgtggcatgtatggcaaaaactgtatccgggggacgccgtttccctgcagggggcagcgcgggacatgctgagcgctctttaccgctgcgacctctctgtcttccagttgtatagccccgcgggcagcggggggcgcaacctcaccacgctgggcatcttcggcgcagccaccaacaaggtggtgtgctcgtcaccactctgccccgcctaccgcaaggaggtcgtggggttggtggacgaccgcgtgtgcaagaagtgcccgccacagcgcctggcgcgtttcgaggaggagtgccgcaagtaccgcacactagtcataaagggtgtgcgcgtcttcgacgtggcggtcttggcgccactgctgcgagacccggccctggacctcaaggtcatccacttggtgcgtgatccccgcgcggtggcgagttcacggatccgctcgcgccacggcctcatccgtgagagcctacaggtggtgcgcagccgagacccgcgagctcaccgcatgcccttcttggaggccgcgggccacaagcttggcgccaagaaggagggcgtgggcggccccgcagactaccacgctctgggcgctatggaggtcatctgcaatagtatggctaagacgctgcagacagccctgcagccccctgactggctgcagggccactacctggtggtgcggtacgaggacctggtgggagaccccgtcaagacactacggagagtgtacgattttgtgggactgttggtgagccccgaaatggagcagtttgccctgaacatgaccagtggctcgggctcctcctccaagcctttcgtggtatctgcacgcaatgccacgcaggccgccaatgcctggcggaccgccctcaccttccagcagatcaaacaggtggaggagttttgctaccagcccatggccgtcctgggctatgagcgggtcaacagccctgaggaggtcaaagacctcagcaagaccctgcttcggaagccccgtctctaaaaggggttcccaggagacctgattccctgtggtgatacctataaagaggatcgtagtgtgtttaaataaacacagtccagactcaaacggaggaagcccacatattctattatagatatataaataatcacacacacacttgctgtcaatgttttgagtcagtgcatttcaaggaacagccacaaaatacacacccctaagaaaaggcaagacttgaacgttctgaccaggtgcccctcttcttctttgccttctcttgtcctctttctcctatttcttaccctgtcctccacctgccttccattttgaagtgggatgttaatgaaatcaagttccagtaacccaaatcttgtttacaaaatattcgtggtatctgtgaacatgttaagagtaatttggatgtgggggtgggggtggagaaaggggaagtggtccagaaacaaaaagccccattgggcatgataagccgaggaggcattcttctaaagcagacttttgtgtaaaaagcaaaggttacatgtgagtattaataaagaagataataaataatattctttttaatatttgcctccattactttggattcacctgtgttacttgtcctcagcttcagatagaatctccttcccctccctcgtttccatttttccagtctctttcctgaaaggcagctaaactgggtgggagcaatttttgcctccttggtaataacctgggggatgttttctcacatgtaaatctcagcctgttaggtgtccaggagtgaaacacatctttgtattctaaaggcagaaaccaaacagggcagtggaagaaaaagcacactactctcttcaactttgaacacaggaagaagcaactccttcaggacttgaaggcatttggtttttcattcctcttcagttaaaatggggaaccttgaagcagagaccaatgttttggtgctgaggctggttcagaaaaaggatttttaaaaaaagtatgtaatttttaaaagttctgatgattagaacacagacctcaggaaagtagcgtgaacatactgctggcgatggtagcagcttcgttggtttagcaaagtgacagaagtatctatttggagtgtttttctgaccctgacacggtatgtggaggtggatgaaagcagcgaagtttcatctgagaaccgtaagggttttcccttttcttacttgcttcccatttaaatcagtgcaagagagaatatgaatttataatgctttacttgggatgcctgtggaatatgttgcttttctttatcatgtttcctaaaagtaaatttgcaaagaaagtaacatgctgcagacagtataaggcttcagccaagagcttcttttagatatgataatgaattgtggtaaagaggaaatgaaaatgaactagtgtgtaggattttgaaatttggtattttccagggagaaaaccgttacattttcctgtagtggttatgatgttgtgtcctgaacccatttggtactgaaacattctgcagaatgttatactatgagaagaaattgtgaagcccaaatgggaacaagagacagtgtagttgtatatgacagtaaatacagtacaagttcactatcaaaaaaaaaaaaaaaaaa

SEQ ID NO: 209 - protein, 530 aa, Artificial Sequence
  CHST2
MSRSPQRALPPGALPRLLQAAPAAAPRALLPQWPRRPGRRWPASPLGMKVFRRKALVLCAGYALLLVLTMLNLLDYKWHKEPLQQCNPDGPLGAAAGAAGGSWGRPGPPPAGPPRAHARLDLRTPYRPPAAAVGAAPAAAAGMAGVAAPPGNGTRGTGGVGDKRQLVYVFTTWRSGSSFFGELFNQNPEVFFLYEPVWHVWQKLYPGDAVSLQGAARDMLSALYRCDLSVFQLYSPAGSGGRNLTTLGIFGAATNKVVCSSPLCPAYRKEVVGLVDDRVCKKCPPQRLARFEEECRKYRTLVIKGVRVFDVAVLAPLLRDPALDLKVIHLVRDPRAVASSRIRSRHGLIRESLQVVRSRDPRAHRMPFLEAAGHKLGAKKEGVGGPADYHALGAMEVICNSMAKTLQTALQPPDWLQGHYLVVRYEDLVGDPVKTLRRVYDFVGLLVSPEMEQFALNMTSGSGSSSKPFVVSARNATQAANAWRTALTFQQIKQVEEFCYQPMAVLGYERVNSPEEVKDLSKTLLRKPRL

SEQ ID NO: 210 - DNA, 4371 bp, Artificial Sequence
  AMPD3
cccctgctgctctcaagtttcccgttggcggcgcggcccgggcgcttcaggtagcctctcggctctctctgctccgctccgcgcccaggtagggcaccgacgggggctgcacgcggctggccggcttcctccctgctgaggcggccctccctcctcccgcggggccctcctggccggggatccgcagcgctgcgccctctgaacgcccggcccccgcgcctgctgcggggcgcggcctggccgggccctggccccggctggcctcagtgcccagcagccccgctccgctctgcccagcgcgtcccctttgctccagccctgcggccgtccctttcggccggcggcatggccctgtcgtccgaacccgctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtaggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccggatgcatttttttaaggcaaaatttctcccttatctactatgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaagtgaatttcttttggcaactttttaaggacatgtgctcttagtacttaagaggctgctcaaggaccttcctatctatttctgtggtcaaattcagactacaggaggtctttttgaatcattatagttagaagaagaatccagtttctgcctgtgaacttatttgactttagattgtctcatcttgtgactttataatgcctgtcccctccactggtcaattcagcatatggaagtataaatgcagtctttttactaggcagatatatatgctatcttacagctaattatgaaattgaatgaaaatccattgttatcttagggattagttttgaaaagcccccgtttatatacatttgccctaacataggaagtattgtgtagtttctcattgtcattttatctgtatcaagtatctttttttaaattgttaaataaagtcagctaggactgtg

SEQ ID NO: 211 - DNA, 4371 bp, Artificial Sequence; identical to SEQ ID NO: 210
  AMPD3

SEQ ID NO: 212 - DNA, 4473 bp, Artificial Sequence
  AMPD3
atatcgctcgttgctactcagctttcaggaggaggctgggcgttagagggaggctgtggcttatctcctgcagctgggcaggacggctgagtttactgttgtaaagaggaagccgccgctttagtttcctcttgtgagggctgtgaagagggccaggacactgcattcaggataccacagccattttgttttggataactgggattacctggggacttcagggctcttggaaattttccactcatatttcatattcacgagagaatttccagcccaggcttttcctgctctggctcactgctgctcacagatatgcaaaacagagacctcctactccagccggcagacaggacccagccagctgcacgcacgcactgactcagctgagcctcctgggtggcaggcagcacctcacccgggtgcatcacttgagtggcatcttcaggaccagtcatggagccaggctcagctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtaggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccggatgcatttttttaaggcaaaatttctcccttatctactatgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaagtgaatttcttttggcaactttttaaggacatgtgctcttagtacttaagaggctgctcaaggaccttcctatctatttctgtggtcaaattcagactacaggaggtctttttgaatcattatagttagaagaagaatccagtttctgcctgtgaacttatttgactttagattgtctcatcttgtgactttataatgcctgtcccctccactggtcaattcagcatatggaagtataaatgcagtctttttactaggcagatatatatgctatcttacagctaattatgaaattgaatgaaaatccattgttatcttagggattagttttgaaaagcccccgtttatatacatttgccctaacataggaagtattgtgtagtttctcattgtcattttatctgtatcaagtatctttttttaaattgttaaataaagtcagctaggactgtg

SEQ ID NO: 213 - DNA, 4298 bp, Artificial Sequence
  AMPD3
agtatcctcatagtctggaggagggagagctgaactctctcttgtcccttctcaaacatgggaacaaagtcaggagggcagggctgccaggtgctgcagattccctgagtttgggaaaatggaagcccacctagttgaacagttcattctttgaattttgaacacttgctttctcctgacacctaagtggccctacatgcttcacatccagttacttattgagctaattttgaaattggcatgctgggtttggtctggggcattcctaagtagacagctgaccccaagtaccagctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtaggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccggatgcatttttttaaggcaaaatttctcccttatctactatgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaagtgaatttcttttggcaactttttaaggacatgtgctcttagtacttaagaggctgctcaaggaccttcctatctatttctgtggtcaaattcagactacaggaggtctttttgaatcattatagttagaagaagaatccagtttctgcctgtgaacttatttgactttagattgtctcatcttgtgactttataatgcctgtcccctccactggtcaattcagcatatggaagtataaatgcagtctttttactaggcagatatatatgctatcttacagctaattatgaaattgaatgaaaatccattgttatcttagggattagttttgaaaagcccccgtttatatacatttgccctaacataggaagtattgtgtagtttctcattgtcattttatctgtatcaagtatctttttttaaattgttaaataaagtcagctaggactgtg

SEQ ID NO: 214 - DNA, 3994 bp, Artificial Sequence
  AMPD3
gtggacggttggcgagggagtgtgtgtgtgtgtgtgtgtgtgtgtgtgtgtgtgtatccaagtgaccagaaggacgcctggaagaaaccaatgcttgcgggttgctgcaactacagggagcaagtcacctgtgcggggccgagacccccagagtctcgcgctgggaaaagttgtgcggggaggggaggacgtcggctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtaggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccggatgcatttttttaaggcaaaatttctcccttatctactatgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaagtgaatttcttttggcaactttttaaggacatgtgctcttagtacttaagaggctgctcaaggaccttcctatctatttctgtggtcaaattcagactacaggaggtctttttgaatcattatagttagaagaagaatccagtttctgcctgtgaacttatttgactttagattgtctcatcttgtgactttataatgcctgtcccctccactggtcaattcagcatatggaagtataaatgcagtctttttactaggcagatatatatgctatcttacagctaattatgaaattgaatgaaaatccattgttatcttagggattagttttgaaaagcccccgtttatatacatttgccctaacataggaagtattgtgtagtttctcattgtcattttatctgtatcaagtatctttttttaaattgttaaataaagtcagctaggactgtg

SEQ ID NO: 215 - protein, 776 aa, Artificial Sequence
  AMPD3
MALSSEPAEMPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTPVVTGATSLPTPAPYAMPEFQRVTISGDYCAGITLEDYEQAAKSLAKALMIREKYARLAYHRFPRITSQYLGHPRADTAPPEEGLPDFHPPPLPQEDPYCLDDAPPNLDYLVHMQGGILFVYDNKKMLEHQEPHSLPYPDLETYTVDMSHILALITDGPTKTYCHRRLNFLESKFSLHEMLNEMSEFKELKSNPHRDFYNVRKVDTHIHAAACMNQKHLLRFIKHTYQTEPDRTVAEKRGRKITLRQVFDGLHMDPYDLTVDSLDVHAGRQTFHRFDKFNSKYNPVGASELRDLYLKTENYLGGEYFARMVKEVARELEESKYQYSEPRLSIYGRSPEEWPNLAYWFIQHKVYSPNMRWIIQVPRIYDIFRSKKLLPNFGKMLENIFLPLFKATINPQDHRELHLFLKYVTGFDSVDDESKHSDHMFSDKSPNPDVWTSEQNPPYSYYLYYMYANIMVLNNLRRERGLSTFLFRPHCGEAGSITHLVSAFLTADNISHGLLLKKSPVLQYLYYLAQIPIAMSPLSNNSLFLEYSKNPLREFLHKGLHVSLSTDDPMQFHYTKEALMEEYAIAAQVWKLSTCDLCEIARNSVLQSGLSHQEKQKFLGQNYYKEGPEGNDIRKTNVAQIRMAFRYETLCNELSFLSDAMKSEEITALTN

SEQ ID NO: 216 - protein, 767 aa, Artificial Sequence
  AMPD3
MPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTPVVTGATSLPTPAPYAMPEFQRVTISGDYCAGITLEDYEQAAKSLAKALMIREKYARLAYHRFPRITSQYLGHPRADTAPPEEGLPDFHPPPLPQEDPYCLDDAPPNLDYLVHMQGGILFVYDNKKMLEHQEPHSLPYPDLETYTVDMSHILALITDGPTKTYCHRRLNFLESKFSLHEMLNEMSEFKELKSNPHRDFYNVRKVDTHIHAAACMNQKHLLRFIKHTYQTEPDRTVAEKRGRKITLRQVFDGLHMDPYDLTVDSLDVHAGRQTFHRFDKFNSKYNPVGASELRDLYLKTENYLGGEYFARMVKEVARELEESKYQYSEPRLSIYGRSPEEWPNLAYWFIQHKVYSPNMRWIIQVPRIYDIFRSKKLLPNFGKMLENIFLPLFKATINPQDHRELHLFLKYVTGFDSVDDESKHSDHMFSDKSPNPDVWTSEQNPPYSYYLYYMYANIMVLNNLRRERGLSTFLFRPHCGEAGSITHLVSAFLTADNISHGLLLKKSPVLQYLYYLAQIPIAMSPLSNNSLFLEYSKNPLREFLHKGLHVSLSTDDPMQFHYTKEALMEEYAIAAQVWKLSTCDLCEIARNSVLQSGLSHQEKQKFLGQNYYKEGPEGNDIRKTNVAQIRMAFRYETLCNELSFLSDAMKSEEITALTN

SEQ ID NO: 217 - protein, 774 aa, Artificial Sequence
  AMPD3
MEPGSAEMPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTPVVTGATSLPTPAPYAMPEFQRVTISGDYCAGITLEDYEQAAKSLAKALMIREKYARLAYHRFPRITSQYLGHPRADTAPPEEGLPDFHPPPLPQEDPYCLDDAPPNLDYLVHMQGGILFVYDNKKMLEHQEPHSLPYPDLETYTVDMSHILALITDGPTKTYCHRRLNFLESKFSLHEMLNEMSEFKELKSNPHRDFYNVRKVDTHIHAAACMNQKHLLRFIKHTYQTEPDRTVAEKRGRKITLRQVFDGLHMDPYDLTVDSLDVHAGRQTFHRFDKFNSKYNPVGASELRDLYLKTENYLGGEYFARMVKEVARELEESKYQYSEPRLSIYGRSPEEWPNLAYWFIQHKVYSPNMRWIIQVPRIYDIFRSKKLLPNFGKMLENIFLPLFKATINPQDHRELHLFLKYVTGFDSVDDESKHSDHMFSDKSPNPDVWTSEQNPPYSYYLYYMYANIMVLNNLRRERGLSTFLFRPHCGEAGSITHLVSAFLTADNISHGLLLKKSPVLQYLYYLAQIPIAMSPLSNNSLFLEYSKNPLREFLHKGLHVSLSTDDPMQFHYTKEALMEEYAIAAQVWKLSTCDLCEIARNSVLQSGLSHQEKQKFLGQNYYKEGPEGNDIRKTNVAQIRMAFRYETLCNELSFLSDAMKSEEITALTN

SEQ ID NO: 218 - protein, 767 aa, Artificial Sequence; identical to SEQ ID NO: 216
  AMPD3

SEQ ID NO: 219 - protein, 608 aa, Artificial Sequence
  AMPD3
MIREKYARLAYHRFPRITSQYLGHPRADTAPPEEGLPDFHPPPLPQEDPYCLDDAPPNLDYLVHMQGGILFVYDNKKMLEHQEPHSLPYPDLETYTVDMSHILALITDGPTKTYCHRRLNFLESKFSLHEMLNEMSEFKELKSNPHRDFYNVRKVDTHIHAAACMNQKHLLRFIKHTYQTEPDRTVAEKRGRKITLRQVFDGLHMDPYDLTVDSLDVHAGRQTFHRFDKFNSKYNPVGASELRDLYLKTENYLGGEYFARMVKEVARELEESKYQYSEPRLSIYGRSPEEWPNLAYWFIQHKVYSPNMRWIIQVPRIYDIFRSKKLLPNFGKMLENIFLPLFKATINPQDHRELHLFLKYVTGFDSVDDESKHSDHMFSDKSPNPDVWTSEQNPPYSYYLYYMYANIMVLNNLRRERGLSTFLFRPHCGEAGSITHLVSAFLTADNISHGLLLKKSPVLQYLYYLAQIPIAMSPLSNNSLFLEYSKNPLREFLHKGLHVSLSTDDPMQFHYTKEALMEEYAIAAQVWKLSTCDLCEIARNSVLQSGLSHQEKQKFLGQNYYKEGPEGNDIRKTNVAQIRMAFRYETLCNELSFLSDAMKSEEITALTN

SEQ ID NO: 220 - DNA, 1395 bp, Artificial Sequence
  CD58
gggccgccggctgccagcccagggcggggcggagccctacttctggccgaccgcgtaggcggtgcttgaacttagggctgcttgtggctgggcactcgcgcagaggccggcccgacgagccatggttgctgggagcgacgcggggcgggccctgggggtcctcagcgtggtctgcctgctgcactgctttggtttcatcagctgtttttcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttgagtctcttccatctcccacactaacttgtgcattgactaatggaagcattgaagtccaatgcatgataccagagcattacaacagccatcgaggacttataatgtactcatgggattgtcctatggagcaatgtaaacgtaactcaaccagtatatattttaagatggaaaatgatcttccacaaaaaatacagtgtactcttagcaatccattatttaatacaacatcatcaatcattttgacaacctgtatcccaagcagcggtcattcaagacacagatatgcacttatacccataccattagcagtaattacaacatgtattgtgctgtatatgaatggtattctgaaatgtgacagaaaaccagacagaaccaagtaagtacactgcaggctgtgcactctgtgccagaacaacagcagccctgctgtagatgcccattacttgggaagccagattgtactcatctgttggttgccttgtacagtaataagaagtaacatcagcagatatactaaccatagtgtattaagtaccaactgtgtgccatgcactgcactagccactctctgcatatcgtttcctggaaccctctcaatgagccttgcaggaggagtatcataccccttgcttagagacagcgcatatgagattcatagaagtcaagtgagatatcaaagtcacgttgctagtaagtgatgggctgggatttaaatctaggtctttggactccaagagttatactgttaaccactacaatacactccctccacctcccatcccagaaaaagttggatcagggatagggttcacttcaggagccagggtcagagctgggcctgtagtcacatataaaagataggacacaaacacaattagcagcagtgttggtttaataaaccgccgta

SEQ ID NO: 221 - DNA, 1153 bp, Artificial Sequence
  CD58
gggccgccggctgccagcccagggcggggcggagccctacttctggccgaccgcgtaggcggtgcttgaacttagggctgcttgtggctgggcactcgcgcagaggccggcccgacgagccatggttgctgggagcgacgcggggcgggccctgggggtcctcagcgtggtctgcctgctgcactgctttggtttcatcagctgtttttcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttgagtctcttccatctcccacactaacttgtgcattgactaatggaagcattgaagtccaatgcatgataccagagcattacaacagccatcgaggacttataatgtactcatgggattgtcctatggagcaatgtaaacgtaactcaaccagtatatattttaagatggaaaatgatcttccacaaaaaatacagtgtactcttagcaatccattatttaatacaacatcatcaatcattttgacaacctgtatcccaagcagcggtcattcaagacacagatatgcacttatacccataccattagcagtaattacaacatgtattgtgctgtatatgaatggtattctgaaatgtgacagaaaaccagacagaaccaactccaattgattggtaacagaagatgaagacaacagcataactaaattattttaaaaactaaaaagccatctgatttctcatttgagtattacaatttttgaacaactgttggaaatgtaacttgaagcagctgctttaagaagaaatacccactaacaaagaacaagcattagttttggctgtcatcaacttattatatgactaggtgcttgctttttttgtcagtaaattgtttttactgatgatgtagatacttttgtaaataaatgtaaatatgtacacaagtga

SEQ ID NO: 222 - protein, 248 aa, Artificial Sequence
  CD58
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNGILKCDRKPDRTK

SEQ ID NO: 223 - protein, 250 aa, Artificial Sequence
  CD58
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNGILKCDRKPDRTNSN

SEQ ID NO: 224 - DNA, 2674 bp, Artificial Sequence
  MINPP1
gatgtaagagtcatctgtaaaagctgtgctgttttggcagcctgggaggctaaggtttagtctaggcgactaaggtttagtccgggctgtattcacacccaaaacaactaaaaaagcggaggagtctttgagtcaatccctgaagctccggctaagaggaaactcgcccacgctccagggcagcgacgccggctccacctcagccacggctgtctcaagcttctcggggttttccgccggctccacccgagccacaagtctacaggactcctcggagctttccgccgggacgcaagacccaccgccagaggttggtacctcctagagaacagcgaagcgcatcccgagggccgccggccggaagcgccctccagacccgccccctgccctccggagccggaagctgggcatctgcagctggctcggcgcactccactgaccgtcccgacgatgctacgcgcgcccggctgcctcctccggacctccgtagcgcctgccgcggccctggctgcggcgctgctctcgtcgcttgcgcgctgctctcttctagagccgagggacccggtggcctcgtcgctcagcccctatttcggcaccaagactcgctacgaggatgtcaaccccgtgctattgtcgggccccgaggctccgtggcgggaccctgagctgctggaggggacctgcaccccggtgcagctggtcgccctcattcgccacggcacccgctaccccacggtcaaacagatccgcaagctgaggcagctgcacgggttgctgcaggcccgcgggtccagggatggcggggctagtagtaccggcagccgcgacctgggtgcagcgctggccgactggcctttgtggtacgcggactggatggacgggcagctagtagagaagggacggcaggatatgcgacagctggcgctgcgtctggcctcgctcttcccggcccttttcagccgtgagaactacggccgcctgcggctcatcaccagttccaagcaccgctgcatggatagcagcgccgccttcctgcaggggctgtggcagcactaccaccctggcttgccgccgccggacgtcgcagatatggagtttggacctccaacagttaatgataaactaatgagattttttgatcactgtgagaagtttttaactgaagtagaaaaaaatgctacagctctttatcacgtggaagccttcaaaactggaccagaaatgcagaacattttaaaaaaagttgcagctactttgcaagtgccagtaaatgatttaaatgcaggtctcagccaatttcttctccagtcatcctccagtttggtcatgcagagactcttcttccactgctttctctcatgggctacttcaaagacaaggaacccctaacagcgtacaattacaaaaaacaaatgcatcggaagttccgaagtggtctcattgtaccttatgcctcgaacctgatatttgtgctttaccactgtgaaaatgctaagactcctaaagaacaattccgagtgcagatgttattaaatgaaaaggtgttacctttggcttactcacaagaaactgtttcattttatgaagatctgaagaaccactacaaggacatccttcagagttgtcaaaccagtgaagaatgtgaattagcaagggctaacagtacatctgatgaactatgagtaactgaagaacatttttaattctttaggaatctgcaatgagtgattacatgcttgtaataggtaggcaattccttgattacaggaagcttttatattacttgagtatttctgtcttttcacagaaaaacattgggtttctctctgggtttggacatgaaatgtaagaaaagatttttcactggagcagctctcttaaggagaaacaaatctatttagagaaacagctggccctgcaaatgtttacagaaatgaaattcttcctacttatataagaaatctcacactgagatagaattgtgatttcataataacacttgaaaagtgctggagtaacaaaatatctcagttggaccatccttaacttgattgaactgtctaggaactttacagattgttctgcagttctctcttcttttcctcaggtaggacagctctagcattttcttaatcaggaatattgtggtaagctgggagtatcactctggaagaaagtaacatctccagatgagaatttgaaacaagaaacagagtgttgtaaaaggacaccttcactgaagcaagtcggaaagtacaatgaaaataaatatttttggtatttatttatgaaatatttgaacattttttcaataattcctttttacttctaggaagtctcaaaagaccatcttaaattattatatgtttggacaattagcaacaagtcagatagttagaatcgaagtttttcaaatccattgcttagctaactttttcattctgtcacttggcttcgatttttatattttcctattatatgaaatgtatcttttggttgtttgatttttctttctttctttgtaaatagttctgagttctgtcaaatgccgtgaaagtatttgctataataaagaaaattcttgtgactttactaccaggacttttctcttccccatgtcaaaatacaatcaataattgatggtaaaagtttggaaattcaagcaaaaaaaaaa

SEQ ID NO: 225 - DNA, 2225 bp, Artificial Sequence
  MINPP1
gcgttttgtgctgctgtcagtagtttttgtccaaagcagaatctttgtaaagtaatacagagttgggaaggttaattgagaaaataaaatactctgtttagactttggcttagagtgaaaaaatagattccatatgttgaattctctctcaccttgtaagtagaaactttgctgatttttagtttgctttctaaagttttccgtgcctgacagaaacagtacttattaatgtatgatgcaatttcattgcgtagcatctctacaacacatttaatcttcaatctctatttctttagccttttctagctattctcatgcgttacagccattataaatggggaataattttaccccaagagtttcctgaccaatatgtgcttatttcagctgtgcggattagtaagatatatggagtttggacctccaacagttaatgataaactaatgagattttttgatcactgtgagaagtttttaactgaagtagaaaaaaatgctacagctctttatcacgtggaagccttcaaaactggaccagaaatgcagaacattttaaaaaaagttgcagctactttgcaagtgccagtaaatgatttaaatgcagatttaattcaagtagcctttttcacctgttcatttgacctggcaattaaaggtgttaaatctccttggtgtgatgtttttgacatagatgatgcaaaggtattagaatatttaaatgatctgaaacaatattggaaaagaggatatgggtatactattaacagtcgatccagctgcaccttgtttcaggatatctttcagcacttggacaaagcagttgaacagaaacaaaggtctcagccaatttcttctccagtcatcctccagtttggtcatgcagagactcttcttccactgctttctctcatgggctacttcaaagacaaggaacccctaacagcgtacaattacaaaaaacaaatgcatcggaagttccgaagtggtctcattgtaccttatgcctcgaacctgatatttgtgctttaccactgtgaaaatgctaagactcctaaagaacaattccgagtgcagatgttattaaatgaaaaggtgttacctttggcttactcacaagaaactgtttcattttatgaagatctgaagaaccactacaaggacatccttcagagttgtcaaaccagtgaagaatgtgaattagcaagggctaacagtacatctgatgaactatgagtaactgaagaacatttttaattctttaggaatctgcaatgagtgattacatgcttgtaataggtaggcaattccttgattacaggaagcttttatattacttgagtatttctgtcttttcacagaaaaacattgggtttctctctgggtttggacatgaaatgtaagaaaagatttttcactggagcagctctcttaaggagaaacaaatctatttagagaaacagctggccctgcaaatgtttacagaaatgaaattcttcctacttatataagaaatctcacactgagatagaattgtgatttcataataacacttgaaaagtgctggagtaacaaaatatctcagttggaccatccttaacttgattgaactgtctaggaactttacagattgttctgcagttctctcttcttttcctcaggtaggacagctctagcattttcttaatcaggaatattgtggtaagctgggagtatcactctggaagaaagtaacatctccagatgagaatttgaaacaagaaacagagtgttgtaaaaggacaccttcactgaagcaagtcggaaagtacaatgaaaataaatatttttggtatttatttatgaaatatttgaacattttttcaataattcctttttacttctaggaagtctcaaaagaccatcttaaattattatatgtttggacaattagcaacaagtcagatagttagaatcgaagtttttcaaatccattgcttagctaactttttcattctgtcacttggcttcgatttttatattttcctattatatgaaatgtatcttttggttgtttgatttttctttctttctttgtaaatagttctgagttctgtcaaatgccgtgaaagtatttgctataataaagaaaattcttgtgactttactaccaggacttttctcttccccatgtcaaaatacaatcaataattgatggtaaaagtttggaaattcaagcaaaaaaaaaa

SEQ ID NO: 226 - DNA, 2906 bp, Artificial Sequence
  MINPP1
gatgtaagagtcatctgtaaaagctgtgctgttttggcagcctgggaggctaaggtttagtctaggcgactaaggtttagtccgggctgtattcacacccaaaacaactaaaaaagcggaggagtctttgagtcaatccctgaagctccggctaagaggaaactcgcccacgctccagggcagcgacgccggctccacctcagccacggctgtctcaagcttctcggggttttccgccggctccacccgagccacaagtctacaggactcctcggagctttccgccgggacgcaagacccaccgccagaggttggtacctcctagagaacagcgaagcgcatcccgagggccgccggccggaagcgccctccagacccgccccctgccctccggagccggaagctgggcatctgcagctggctcggcgcactccactgaccgtcccgacgatgctacgcgcgcccggctgcctcctccggacctccgtagcgcctgccgcggccctggctgcggcgctgctctcgtcgcttgcgcgctgctctcttctagagccgagggacccggtggcctcgtcgctcagcccctatttcggcaccaagactcgctacgaggatgtcaaccccgtgctattgtcgggccccgaggctccgtggcgggaccctgagctgctggaggggacctgcaccccggtgcagctggtcgccctcattcgccacggcacccgctaccccacggtcaaacagatccgcaagctgaggcagctgcacgggttgctgcaggcccgcgggtccagggatggcggggctagtagtaccggcagccgcgacctgggtgcagcgctggccgactggcctttgtggtacgcggactggatggacgggcagctagtagagaagggacggcaggatatgcgacagctggcgctgcgtctggcctcgctcttcccggcccttttcagccgtgagaactacggccgcctgcggctcatcaccagttccaagcaccgctgcatggatagcagcgccgccttcctgcaggggctgtggcagcactaccaccctggcttgccgccgccggacgtcgcagatatggagtttggacctccaacagttaatgataaactaatgagattttttgatcactgtgagaagtttttaactgaagtagaaaaaaatgctacagctctttatcacgtggaagccttcaaaactggaccagaaatgcagaacattttaaaaaaagttgcagctactttgcaagtgccagtaaatgatttaaatgcagatttaattcaagtagcctttttcacctgttcatttgacctggcaattaaaggtgttaaatctccttggtgtgatgtttttgacatagatgatgcaaaggtattagaatatttaaatgatctgaaacaatattggaaaagaggatatgggtatactattaacagtcgatccagctgcaccttgtttcaggatatctttcagcacttggacaaagcagttgaacagaaacaaaggtctcagccaatttcttctccagtcatcctccagtttggtcatgcagagactcttcttccactgctttctctcatgggctacttcaaagacaaggaacccctaacagcgtacaattacaaaaaacaaatgcatcggaagttccgaagtggtctcattgtaccttatgcctcgaacctgatatttgtgctttaccactgtgaaaatgctaagactcctaaagaacaattccgagtgcagatgttattaaatgaaaaggtgttacctttggcttactcacaagaaactgtttcattttatgaagatctgaagaaccactacaaggacatccttcagagttgtcaaaccagtgaagaatgtgaattagcaagggctaacagtacatctgatgaactatgagtaactgaagaacatttttaattctttaggaatctgcaatgagtgattacatgcttgtaataggtaggcaattccttgattacaggaagcttttatattacttgagtatttctgtcttttcacagaaaaacattgggtttctctctgggtttggacatgaaatgtaagaaaagatttttcactggagcagctctcttaaggagaaacaaatctatttagagaaacagctggccctgcaaatgtttacagaaatgaaattcttcctacttatataagaaatctcacactgagatagaattgtgatttcataataacacttgaaaagtgctggagtaacaaaatatctcagttggaccatccttaacttgattgaactgtctaggaactttacagattgttctgcagttctctcttcttttcctcaggtaggacagctctagcattttcttaatcaggaatattgtggtaagctgggagtatcactctggaagaaagtaacatctccagatgagaatttgaaacaagaaacagagtgttgtaaaaggacaccttcactgaagcaagtcggaaagtacaatgaaaataaatatttttggtatttatttatgaaatatttgaacattttttcaataattcctttttacttctaggaagtctcaaaagaccatcttaaattattatatgtttggacaattagcaacaagtcagatagttagaatcgaagtttttcaaatccattgcttagctaactttttcattctgtcacttggcttcgatttttatattttcctattatatgaaatgtatcttttggttgtttgatttttctttctttctttgtaaatagttctgagttctgtcaaatgccgtgaaagtatttgctataataaagaaaattcttgtgactttactaccaggacttttctcttccccatgtcaaaatacaatcaataattgatggtaaaagtttggaaattcaagcaaaaaaaaaa

SEQ ID NO: 227 - protein, 312 aa, Artificial Sequence
  MINPP1
MLRAPGCLLRTSVAPAAALAAALLSSLARCSLLEPRDPVASSLSPYFGTKTRYEDVNPVLLSGPEAPWRDPELLEGTCTPVQLVALIRHGTRYPTVKQIRKLRQLHGLLQARGSRDGGASSTGSRDLGAALADWPLWYADWMDGQLVEKGRQDMRQLALRLASLFPALFSRENYGRLRLITSSKHRCMDSSAAFLQGLWQHYHPGLPPPDVADMEFGPPTVNDKLMRFFDHCEKFLTEVEKNATALYHVEAFKTGPEMQNILKKVAATLQVPVNDLNAGLSQFLLQSSSSLVMQRLFFHCFLSWATSKTRNP

SEQ ID NO: 228 - protein, 286 aa, Artificial Sequence
  MINPP1
MCLFQLCGLVRYMEFGPPTVNDKLMRFFDHCEKFLTEVEKNATALYHVEAFKTGPEMQNILKKVAATLQVPVNDLNADLIQVAFFTCSFDLAIKGVKSPWCDVFDIDDAKVLEYLNDLKQYWKRGYGYTINSRSSCTLFQDIFQHLDKAVEQKQRSQPISSPVILQFGHAETLLPLLSLMGYFKDKEPLTAYNYKKQMHRKFRSGLIVPYASNLIFVLYHCENAKTPKEQFRVQMLLNEKVLPLAYSQETVSFYEDLKNHYKDILQSCQTSEECELARANSTSDEL

SEQ ID NO: 229 - protein, 487 aa, Artificial Sequence
  MINPP1
MLRAPGCLLRTSVAPAAALAAALLSSLARCSLLEPRDPVASSLSPYFGTKTRYEDVNPVLLSGPEAPWRDPELLEGTCTPVQLVALIRHGTRYPTVKQIRKLRQLHGLLQARGSRDGGASSTGSRDLGAALADWPLWYADWMDGQLVEKGRQDMRQLALRLASLFPALFSRENYGRLRLITSSKHRCMDSSAAFLQGLWQHYHPGLPPPDVADMEFGPPTVNDKLMRFFDHCEKFLTEVEKNATALYHVEAFKTGPEMQNILKKVAATLQVPVNDLNADLIQVAFFTCSFDLAIKGVKSPWCDVFDIDDAKVLEYLNDLKQYWKRGYGYTINSRSSCTLFQDIFQHLDKAVEQKQRSQPISSPVILQFGHAETLLPLLSLMGYFKDKEPLTAYNYKKQMHRKFRSGLIVPYASNLIFVLYHCENAKTPKEQFRVQMLLNEKVLPLAYSQETVSFYEDLKNHYKDILQSCQTSEECELARANSTSDEL

SEQ ID NO: 230 - DNA, 1578 bp, Artificial Sequence
  IDH2
attttgcaacgccataggcttccagcgactgctggtgatgtttctgatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaa

SEQ ID NO: 231 - DNA, 1560 bp, Artificial Sequence
  IDH2
tccccggcaaggcccaatggggcggcaggcccggcagccccgccccggtggtgcccgcgcggccagcgcccgccaggcccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaaaaaaaaa

SEQ ID NO: 232 - DNA, 1818 bp, Artificial Sequence
  IDH2
tccccggcaaggcccaatggggcggcaggcccggcagccccgccccggtggtgcccgcgcggccagcgcccgccaggcccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaaaaaaaaa

SEQ ID NO: 233 - protein, 400 aa, Artificial Sequence
  IDH2
MDGDEMTRIIWQFIKEKLILPHVDIQLKYFDLGLPNRDQTDDQVTIDSALATQKYSVAVKCATITPDEARVEEFKLKKMWKSPNGTIRNILGGTVFREPIICKNIPRLVPGWTKPITIGRHAHGDQYKATDFVADRAGTFKMVFTPKDGSGVKEWEVYNFPAGGVGMGMYNTDESISGFAHSCFQYAIQKKWPLYMSTKNTILKAYDGRFKDIFQEIFDKHYKTDFDKNKIWYEHRLIDDMVAQVLKSSGGFVWACKNYDGDVQSDILAQGFGSLGLMTSVLVCPDGKTIEAEAAHGTVTRHYREHQKGRPTSTNPIASIFAWTRGLEHRGKLDGNQDLIRFAQMLEKVCVETVESGAMTKDLAGCIHGLSNVKLNEHFLNTTDFLDTIKSNLDRALGRQ

SEQ ID NO: 234 - protein, 322 aa, Artificial Sequence
  IDH2
MWKSPNGTIRNILGGTVFREPIICKNIPRLVPGWTKPITIGRHAHGDQYKATDFVADRAGTFKMVFTPKDGSGVKEWEVYNFPAGGVGMGMYNTDESISGFAHSCFQYAIQKKWPLYMSTKNTILKAYDGRFKDIFQEIFDKHYKTDFDKNKIWYEHRLIDDMVAQVLKSSGGFVWACKNYDGDVQSDILAQGFGSLGLMTSVLVCPDGKTIEAEAAHGTVTRHYREHQKGRPTSTNPIASIFAWTRGLEHRGKLDGNQDLIRFAQMLEKVCVETVESGAMTKDLAGCIHGLSNVKLNEHFLNTTDFLDTIKSNLDRALGRQ

SEQ ID NO: 235 - protein, 452 aa, Artificial Sequence
  IDH2
MAGYLRVVRSLCRASGSRPAWAPAALTAPTSQEQPRRHYADKRIKVAKPVVEMDGDEMTRIIWQFIKEKLILPHVDIQLKYFDLGLPNRDQTDDQVTIDSALATQKYSVAVKCATITPDEARVEEFKLKKMWKSPNGTIRNILGGTVFREPIICKNIPRLVPGWTKPITIGRHAHGDQYKATDFVADRAGTFKMVFTPKDGSGVKEWEVYNFPAGGVGMGMYNTDESISGFAHSCFQYAIQKKWPLYMSTKNTILKAYDGRFKDIFQEIFDKHYKTDFDKNKIWYEHRLIDDMVAQVLKSSGGFVWACKNYDGDVQSDILAQGFGSLGLMTSVLVCPDGKTIEAEAAHGTVTRHYREHQKGRPTSTNPIASIFAWTRGLEHRGKLDGNQDLIRFAQMLEKVCVETVESGAMTKDLAGCIHGLSNVKLNEHFLNTTDFLDTIKSNLDRALGRQ

SEQ ID NO: 236 - DNA, 913 bp, Artificial Sequence
  CD70
ccagagaggggcaggctggtcccctgacaggttgaagcaagtagacgcccaggagccccgggagggggctgcagtttccttccttccttctcggcagcgctccgcgcccccatcgcccctcctgcgctagcggaggtgatcgccgcggcgatgccggaggagggttcgggctgctcggtgcggcgcaggccctatgggtgcgtcctgcgggctgctttggtcccattggtcgcgggcttggtgatctgcctcgtggtgtgcatccagcgcttcgcacaggctcagcagcagctgccgctcgagtcacttgggtgggacgtagctgagctgcagctgaatcacacaggacctcagcaggaccccaggctatactggcaggggggcccagcactgggccgctccttcctgcatggaccagagctggacaaggggcagctacgtatccatcgtgatggcatctacatggtacacatccaggtgacgctggccatctgctcctccacgacggcctccaggcaccaccccaccaccctggccgtgggaatctgctctcccgcctcccgtagcatcagcctgctgcgtctcagcttccaccaaggttgtaccattgcctcccagcgcctgacgcccctggcccgaggggacacactctgcaccaacctcactgggacacttttgccttcccgaaacactgatgagaccttctttggagtgcagtgggtgcgcccctgaccactgctgctgattagggttttttaaattttattttattttatttaagttcaagagaaaaagtgtacacacaggggccacccggggttggggtgggagtgtggtggggggtagtggtggcaggacaagagaaggcattgagctttttctttcattttcctattaaaaaatacaaaaatca

SEQ ID NO: 237 - protein, 193 aa, Artificial Sequence
  CD70
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 238 - DNA, 1312 bp, Artificial Sequence
  HLA-DRA
ttttaatggtcagactctattacaccccacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacaaacagccctgtggaactgagagagcccaacgtcctcatctgtttcatagacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggattgcgcaaaagcaatgcagcagaacgcagggggcctctgtaaggcacatggaggtgatggtgtttcttagagagaagatcactgaagaaacttctgctttaatggctttacaaagctggcaatattacaatccttgacctcagtgaaagcagtcatcttcagcattttccagccctatagccaccccaagtgtggatatgcctcttcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaaaaaaaaaaaaaaaaaaaaaaaaaaaaaaaaaa

SEQ ID NO: 239 - protein, 254 aa, Artificial Sequence
  HLA-DRA
MAISGVPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSNYTPITNVPPEVTVLTNSPVELREPNVLICFIDKFTPPVVNVTWLRNGKPVTTGVSETVFLPREDHLFRKFHYLPFLPSTEDVYDCRVEHWGLDEPLLKHWEFDAPSPLPETTENVVCALGLTVGLVGIIIGTIFIIKGLRKSNAAERRGPL

SEQ ID NO: 240 - DNA, 9560 bp, Artificial Sequence
  NX1
ctctctctctctctctctctctctctttctttctttccgatggggaagagagggtggtgacaagttagaagcgcttgcggaaggtccccgcccccaggatcaggctccccctgcaaggggacgatgcaaaggtaaaagcacctcgctccgcagcatccagacctggaggggctgcgaccacgggccgagcccacccattccccagccaaaggacgggcccgccgctctccatggtactgcggagagctcagctccgcccttctctttcagaaggacagcacccggcgtcacgtaacccagccttctcaggctccaccaccgccttttccttcccagctctttccctctcctccccctcctcctccttctcctcctcctcctcctcctgctcccctccgttgcctgttctcccctcccgcactcctggagatagacgctcaagcctgacgcctctgaaaaggcagcagcagtcgccttatccatagacctcaggaaattcgctttgaccgatgcatgcttcaggctctggctcgagctgaggggaataaccgggcagatgtctgagtccttaaaaaagacaagataaaaccaaaatgcatcaccaacacacaaccaattgatgtgctggcatcttagcttggccctgcagaggcagagagaaaagaagaggagctgttgcgatttccacatctaacagcttctggctatttcgcaactgctgggtttgagtcctactgttgccgtggctgaaaagagaagtaaaatccaacttgtgagaccacgcacaaggaattaggctttggctgcagcggtgctgaagcccatgctatgacagaagaagcaggcctttgaagctatcctcgggttaagaaatggtgccctaaagaggcaagcatccctttctccgttctgctgtaagacaccacatctgaaggagacagacttgaggcattcacaagcatccaaggatactggctcactgctggcttcctgtactttcttgagaaaagtgttttctttttactgactctcactgcttccttttggcctggtaccactggtggaacctggcagataatgggatttgaggagttaagtatctgttgacactgcagatactcttaaattagttaatcagactcaaatgggtcagtgctttcccttgatcttttgttgaagccttttccagaacgttgtctccaaagtgcatcctccctttggtctggaagttctgtggctaccctgtaccactggggtcaacgttttccagttggaagaggactacagggagagagggcggggttattggaagaagaagaagaaaaaaagaactagataaaggagggcacatccctctcactcccgcctttccccttacctttctgtctctcgggacccttatttcttcgtcacggtgtccaggaccattttgaccctgtcggccccggcacccccccgccgcaccccagccccgagcatggggacggcgctgctccagcgcgggggctgttttcttctgtgcctctcgctgctgctcctgggctgctgggcggagctgggcagcgggctggagtttccgggcgccgagggccaatggacgcgcttccccaagtggaacgcctgctgcgagagcgagatgagcttccagctcaagactcgcagcgcccgcggcctcgtgctctacttcgacgacgagggcttctgcgacttcctggagctgattctgacgcgcggcggccgcctgcagctcagcttctccatcttctgcgctgagcctgcgacgctcctggccgacacgccggttaacgacggcgcctggcacagcgtgcgcatccgccgccagttccgcaacaccacgctcttcatcgaccaggtggaggccaagtgggtggaggtcaagtccaagcgcagggacatgacggtgttcagcggccttttcgtcggggggctgcccccggaactgcgcgccgcggcgctcaagctcaccctggcctcggtgagggagcgggagcccttcaaggggtggattcgtgacgtgagggtcaactcctcgcaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaagaaataaaattcggtcttcagtgtgttttgccggtgctgttacatgacaatgaccaaggaaaatactgttgtataaatacagcaaagcctctaacagaaaaagacaacaatgtggaaggtctggcgcacctgatgatgggcgaccaaggtaaaagtaaaggaaaagaagaatatattgccacgttcaaaggatctgaatacttctgctacgacttgtctcaaaaccccattcaaagcagcagtgatgaaataactctgtcatttaaaacccttcagaggaatggactgatgcttcacactgggaaatcggctgattatgtcaatcttgccctgaaaaatggagctgtctctctggtcattaatttgggatcaggggcctttgaagcactagtggagcctgtgaatggaaagtttaatgataatgcctggcatgatgtgaaagtcaccaggaatctgcgtcagcactcaggcattggacacgctatggtaaacaaactacattgttcggtgacaatatcagtggatgggattcttaccacaacgggctacacgcaagaagattataccatgctggggtctgatgactttttctatgttggaggcagtcccagcacagccgaccttccagggtcaccagtcagtaacaactttatgggctgtctcaaagaggttgtatataaaaataatgatgtgaggctggaattatctcgacttgccaagcaaggagatcctaagatgaagatccatggagtggtggcatttaaatgtgagaatgttgcaactttagacccaatcacctttgaaaccccagagtctttcatctctttgcctaaatggaatgcaaagaaaactggctccatatcatttgatttccgtacaacagagccaaatggcctcatcttatttagccatggcaagccaagacatcagaaagatgccaagcacccacagatgataaaggtggacttctttgctattgagatgctagatggccacctctacctcctcctggacatggggtcaggtactataaaaataaaagccctgttgaagaaagtgaatgatggagaatggtatcatgtggacttccagagagacggacggtcaggtaccatttctgtcaacacgttgcgtactccctacactgctcctggtgagagtgagattctggacctggatgatgagttgtacctgggggggctgccagaaaataaagctggccttgtcttccccaccgaggtgtggactgctctgctcaactatggctacgtgggctgcatcagggatttgttcatcgatggccaaagcaaagatatccggcaaatggctgaagttcaaagtactgctggagtgaagccttcctgctcaaaggaaacagcaaaaccgtgccttagcaacccttgcaaaaacaatggcatgtgcagggatgggtggaacagatatgtctgtgattgttccggaacaggctatcttggcaggtcctgtgagagagaggcaacggttttgagctatgatgggagcatgtttatgaaaattcagctccccgtagtcatgcatacggaggctgaggatgtttccttacggttccgatcccagcgtgcatatggcattctgatggcaaccacttctagagactctgctgacaccctccgcctggagctagacgcaggacgtgtgaaactgacggtcaatctagattgtatcaggattaactgtaattccagcaaaggtcccgagactctttttgctggctataacctcaatgataacgagtggcacacagtgcgtgtagttcggcgtggaaaaagtttaaagttaacagtggatgaccaacaggccatgacaggtcaaatggcaggtgatcatactaggctggagttccataacatagagactggcatcatcacagaacgacggtatctttcttctgtcccctccaacttcattggacacctgcagagcttgacatttaatggaatggcatacattgacctgtgtaaaaatggcgacatagattactgtgagcttaatgccagatttggcttcaggaacatcatagcagatcctgtcaccttcaagaccaaatcgagctatgttgccttagctaccttgcaagcctacacttctatgcatctttttttccagttcaagacaacatccctagatggattaattctatataacagtggggatggaaatgactttattgtggttgaattagttaaagggtacttacattacgtgtttgatttgggaaatggtgctaacctcatcaaaggaagctcaaataaacctctcaatgacaatcagtggcacaacgtgatgatatcaagggacaccagcaacctccacactgtaaagattgacacaaaaatcacaacgcaaatcaccgccggagccaggaacttagacctcaagagtgacttatatataggaggagtagctaaagaaacatacaaatccttaccaaaacttgtacatgccaaagaaggctttcaaggctgcctggcatcagttgatttaaatggacggcttccggacctcatctccgatgctcttttctgcaacggacagatcgagagaggatgtgaagggcccagcacaacctgccaagaggactcatgttccaatcaaggtgtgtgcttgcaacaatgggatggcttcagctgtgactgtagtatgacttccttcagtggaccactctgcaatgaccctgggacgacatatatctttagcaaaggtggtggacaaatcacgtataagtggcctcctaatgaccgacccagtacacgagcagacagactggccataggttttagcactgttcagaaagaagccgtattggtgcgagtggacagttcttcaggcttgggtgactacctagaactgcatatacaccagggaaaaattggagttaagtttaatgttgggacagatgacatcgccattgaagaatccaatgcaatcattaatgatgggaaataccatgtagttcgtttcacgaggagtggtggcaatgccacgttgcaggtggacagctggccagtgatcgagcgctaccctgcaggaaacaatgataacgagcgcctggcgattgctagacagcgaattccatatcgacttggtcgagtagttgatgaatggctactcgacaaagggcgtcagctcacaatcttcaatagccaagcaaccataataattggcgggaaagagcagggccagcccttccagggccagctctctgggctgtactacaatggcttgaaagttctgaatatggcagccgaaaacgatgccaacatcgccatagtgggaaatgtgagactggttggtgaagtgccttcctctatgacaactgagtcaacagccactgccatgcaatcagagatgtccacatcaattatggagactaccacgaccctggctactagcacagccagaagaggaaagcccccgacaaaagaacccattagccagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaacaaaaaacaaaaaacaggggccaataaattccctaacatccacagtgttttcatttactctgcttgtctttatgttgctggaacatttctaaaagacagtgatgaccgcacgcattcataaagcaaaggagtactacagcatcaaggcacaacacaaaaaccaacacaaaacataacacaaaaaagaagctacctatgatcctggatttagccaaagtgctagcgctttcctgagaagtcagtccaattgccagagaagactgtccttttgagtgactcaacctgcaaacctttaagagtttgccgcctggtgcaactggagcagtggttggaacttgcatttgaaacaaagtgctggcttttttgaagacttgtgtaggaacacattcaaaaagcccctttctggttgtgagagaggaaaaaaaagtatggaggccttattttcaaaaatgtgaaatataaggcacgttttcacacaaaatttcaaaacaaaaacaagagggcatagatgcaatcattgggaaattttcatgcacgcttattatgttattacatatgtttatataaaatccatctctgtgtgctttctggactgtgataagtgacgttttatagcctgttgtatagaaaatgcaaaatatatctctgctcttcagccatttttggtaaattcaatgttataagtgttgctaagtatagggagttttatgacatcagagcaacaattatttcagttgggtttttctttttttttgccaccattataaattgccacaattacttttattttttaaagaaattacagtgtagtgtttattctaaggaagatatgtatgaatgtatatacaaagactcagctacttcttttcttatatgtacagccttcattctgttgcaattaagttttagtacttgtatgaaaggtgtgaattagaaagtcacatatatacatatgtatcttataatcttttctccctgaaatactcacattcccacatacattcactattttcacacacacacacacacacacacacacacacacacacacacacacacgaatccacagcaatccatcagatatgctggaagatccaaacgtgcatacagtagcaaatatttattgacaaattgaaaagcaggaaggaagagggttgtgccaaggtattgatgacaaatggggtgatttgcttcattgagatcttgctcccaggtaaccttaagaagattttagtccctaaagaaatgaacctttccttatcaaatagaatatcactgatatactgctgcatgaataagaaccattatgtgggcaggttatggaagcaaaattggttaatctacaccttaactctggctgctgcaattgaaaactttctttctaataaaataatatatatatctctgaatctgatgtgcatgatgaacatttctggaaagtaaacactttctctcgactaagaaagtatttttcagtaatttttgattctgtattactacccacttaaaaaatcattctctgttaattattgactatgttttaacttttctggttttacatatatatcattaaatatagttttagtttaacacattaagtagtggaaaagtatagattatacacttgttttgcatattattcaatgatgttcacagcaataaattactaatatgagaaggtagtgcaaaaaatgcattattacattgcaagttgatgtttcaggaaaaattggttgcattacttgaataccttctaaaagaacgataaaaaattttgtagaagagaagaatatctttccaattagctttaatcagcaaaggcaaaaaatgcaaaacatcttttgtgatactttagttgatgaaaaaaaagccaagaagtggcctggatttcagacatacagcaccttagaaatatgtataattcatagcaaatcaccactatctatggttgccaagtaattgttgtgtacaaagaaatttagtggctttttatgacccagaaagtagaaggtataaaatgaaaatttaatatccattgcttcttttctagattttcattttttttaatttgccacattaaataattcacgagtcttttcttttcccccgtctcattcagtcttactcagggaaagccagttaaataagaagggaagtgtaaaactactaatttacagcttgaagggtttttttttttaagattgcttttctattttatctattaagcttgaaccagtttccatctggaaagattctaaaatataatagaaaataaattgaataatggtaattttaagcagtatatctatgaaatgtgttgtttgggattgatttcaatgtttctccccagcgtaaattttaaagttacatgcaatgattgatatagtttattatcagcaaaattatttctaatattattggcttacacaaactctagcaaaaattattttttcctcaatggaaaaagaaaagagaggaacagagttagaaagagaaaatgacttgaatcccaagtatcttcataccaaacatatcagggttccctgcatagtttgcagttgattgaggatttcacacgacttggcataaatttgattacatctctagactgtaacttttctgattgattatgcttcttttttatccatgtaatgtgttgccttttttaaaagaacaaatactacaataacgtgtgaagtggtcaatccctaagacatcaaagaaaggccacataaccctacccttctagtgctttgtgtgattgggtatcaaaggggttttcttcttctttttttgtttgtttgtttttctgttgcaaggccaatttatccattattggaaatgctaagcaagtggaatttactgttttgttaataaaatatttcttaatacaactgtgatttattgattttaaaaattatatgcggcaccatttcgtgcttaagtgggaaagtaaagaaggctgcatttgaagggaagacccatccttatattatagaggaagaatgttgactctcttttttctggatttaactagtcattaaagacctctatattcatacacttaaagatgtagccattaaatgtacttttgttatatttgttcatcttgatatgccagaaaccataaactcatacagtattagttgcaaacaatattaaaatactaatttcataaatatgctttttctctataaaagacaatggaatccaagttaagtaaacctgtgattaaattccaacactatcaca

SEQ ID NO: 241 - DNA, 4088 bp, Artificial Sequence
  NX1
acgtgactgacagagcgttttctgtgtcttttctcgcccatctgtgtgcagggcactgataggccgggctgatgcgcaggcaatttatcatcttgatctcccactgagtcagggagctctcctgtcaccagtattgatttcagaggatggactaaatttcctaggatttccattaagaattaagaaaaaagctctaagcacgcagggtagccagacagacatggatatgagatggcactgtgaaaacttgcagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaacaaaaaacaaaaaacaggggccaataaattccctaacatccacagtgttttcatttactctgcttgtctttatgttgctggaacatttctaaaagacagtgatgaccgcacgcattcataaagcaaaggagtactacagcatcaaggcacaacacaaaaaccaacacaaaacataacacaaaaaagaagctacctatgatcctggatttagccaaagtgctagcgctttcctgagaagtcagtccaattgccagagaagactgtccttttgagtgactcaacctgcaaacctttaagagtttgccgcctggtgcaactggagcagtggttggaacttgcatttgaaacaaagtgctggcttttttgaagacttgtgtaggaacacattcaaaaagcccctttctggttgtgagagaggaaaaaaaagtatggaggccttattttcaaaaatgtgaaatataaggcacgttttcacacaaaatttcaaaacaaaaacaagagggcatagatgcaatcattgggaaattttcatgcacgcttattatgttattacatatgtttatataaaatccatctctgtgtgctttctggactgtgataagtgacgttttatagcctgttgtatagaaaatgcaaaatatatctctgctcttcagccatttttggtaaattcaatgttataagtgttgctaagtatagggagttttatgacatcagagcaacaattatttcagttgggtttttctttttttttgccaccattataaattgccacaattacttttattttttaaagaaattacagtgtagtgtttattctaaggaagatatgtatgaatgtatatacaaagactcagctacttcttttcttatatgtacagccttcattctgttgcaattaagttttagtacttgtatgaaaggtgtgaattagaaagtcacatatatacatatgtatcttataatcttttctccctgaaatactcacattcccacatacattcactattttcacacacacacacacacacacacacacacacacacacacacacacacgaatccacagcaatccatcagatatgctggaagatccaaacgtgcatacagtagcaaatatttattgacaaattgaaaagcaggaaggaagagggttgtgccaaggtattgatgacaaatggggtgatttgcttcattgagatcttgctcccaggtaaccttaagaagattttagtccctaaagaaatgaacctttccttatcaaatagaatatcactgatatactgctgcatgaataagaaccattatgtgggcaggttatggaagcaaaattggttaatctacaccttaactctggctgctgcaattgaaaactttctttctaataaaataatatatatatctctgaatctgatgtgcatgatgaacatttctggaaagtaaacactttctctcgactaagaaagtatttttcagtaatttttgattctgtattactacccacttaaaaaatcattctctgttaattattgactatgttttaacttttctggttttacatatatatcattaaatatagttttagtttaacacattaagtagtggaaaagtatagattatacacttgttttgcatattattcaatgatgttcacagcaataaattactaatatgagaaggtagtgcaaaaaatgcattattacattgcaagttgatgtttcaggaaaaattggttgcattacttgaataccttctaaaagaacgataaaaaattttgtagaagagaagaatatctttccaattagctttaatcagcaaaggcaaaaaatgcaaaacatcttttgtgatactttagttgatgaaaaaaaagccaagaagtggcctggatttcagacatacagcaccttagaaatatgtataattcatagcaaatcaccactatctatggttgccaagtaattgttgtgtacaaagaaatttagtggctttttatgacccagaaagtagaaggtataaaatgaaaatttaatatccattgcttcttttctagattttcattttttttaatttgccacattaaataattcacgagtcttttcttttcccccgtctcattcagtcttactcagggaaagccagttaaataagaagggaagtgtaaaactactaatttacagcttgaagggtttttttttttaagattgcttttctattttatctattaagcttgaaccagtttccatctggaaagattctaaaatataatagaaaataaattgaataatggtaattttaagcagtatatctatgaaatgtgttgtttgggattgatttcaatgtttctccccagcgtaaattttaaagttacatgcaatgattgatatagtttattatcagcaaaattatttctaatattattggcttacacaaactctagcaaaaattattttttcctcaatggaaaaagaaaagagaggaacagagttagaaagagaaaatgacttgaatcccaagtatcttcataccaaacatatcagggttccctgcatagtttgcagttgattgaggatttcacacgacttggcataaatttgattacatctctagactgtaacttttctgattgattatgcttcttttttatccatgtaatgtgttgccttttttaaaagaacaaatactacaataacgtgtgaagtggtcaatccctaagacatcaaagaaaggccacataaccctacccttctagtgctttgtgtgattgggtatcaaaggggttttcttcttctttttttgtttgtttgtttttctgttgcaaggccaatttatccattattggaaatgctaagcaagtggaatttactgttttgttaataaaatatttcttaatacaactgtgatttattgattttaaaaattatatgcggcaccatttcgtgcttaagtgggaaagtaaagaaggctgcatttgaagggaagacccatccttatattatagaggaagaatgttgactctcttttttctggatttaactagtcattaaagacctctatattcatacacttaaagatgtagccattaaatgtacttttgttatatttgttcatcttgatatgccagaaaccataaactcatacagtattagttgcaaacaatattaaaatactaatttcataaatatgctttttctctataaaagacaatggaatccaagttaagtaaacctgtgattaaattccaacactatcaca

SEQ ID NO: 242 - DNA, 4062 bp, Artificial Sequence
  NX1
ttttctgtgtcttttctcgcccatctgtgtgcagggcactgataggccgggctgatgcgcaggcaatttatcatcttgatctcccactgagtcagggagctctcctgtcaccagtattgatttcagaggatggactaaatttcctaggatttccattaagaattaagaaaaaagctctaagcacgcagggtagccagacagacatggatatgagatggcactgtgaaaacttgcagaccacagatgacatccttgtggcctcagcagagtgtcccagcgatgatgaggacattgacccctgtgagccgagctcagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaacaaaaaacaaaaaacaggggccaataaattccctaacatccacagtgttttcatttactctgcttgtctttatgttgctggaacatttctaaaagacagtgatgaccgcacgcattcataaagcaaaggagtactacagcatcaaggcacaacacaaaaaccaacacaaaacataacacaaaaaagaagctacctatgatcctggatttagccaaagtgctagcgctttcctgagaagtcagtccaattgccagagaagactgtccttttgagtgactcaacctgcaaacctttaagagtttgccgcctggtgcaactggagcagtggttggaacttgcatttgaaacaaagtgctggcttttttgaagacttgtgtaggaacacattcaaaaagcccctttctggttgtgagagaggaaaaaaaagtatggaggccttattttcaaaaatgtgaaatataaggcacgttttcacacaaaatttcaaaacaaaaacaagagggcatagatgcaatcattgggaaattttcatgcacgcttattatgttattacatatgtttatataaaatccatctctgtgtgctttctggactgtgataagtgacgttttatagcctgttgtatagaaaatgcaaaatatatctctgctcttcagccatttttggtaaattcaatgttataagtgttgctaagtatagggagttttatgacatcagagcaacaattatttcagttgggtttttctttttttttgccaccattataaattgccacaattacttttattttttaaagaaattacagtgtagtgtttattctaaggaagatatgtatgaatgtatatacaaagactcagctacttcttttcttatatgtacagccttcattctgttgcaattaagttttagtacttgtatgaaaggtgtgaattagaaagtcacatatatacatatgtatcttataatcttttctccctgaaatactcacattcccacatacattcactattttcacacacacacacacacacacacacacacacacacacacacacacacgaatccacagcaatccatcagatatgctggaagatccaaacgtgcatacagtagcaaatatttattgacaaattgaaaagcaggaaggaagagggttgtgccaaggtattgatgacaaatggggtgatttgcttcattgagatcttgctcccaggtaaccttaagaagattttagtccctaaagaaatgaacctttccttatcaaatagaatatcactgatatactgctgcatgaataagaaccattatgtgggcaggttatggaagcaaaattggttaatctacaccttaactctggctgctgcaattgaaaactttctttctaataaaataatatatatatctctgaatctgatgtgcatgatgaacatttctggaaagtaaacactttctctcgactaagaaagtatttttcagtaatttttgattctgtattactacccacttaaaaaatcattctctgttaattattgactatgttttaacttttctggttttacatatatatcattaaatatagttttagtttaacacattaagtagtggaaaagtatagattatacacttgttttgcatattattcaatgatgttcacagcaataaattactaatatgagaaggtagtgcaaaaaatgcattattacattgcaagttgatgtttcaggaaaaattggttgcattacttgaataccttctaaaagaacgataaaaaattttgtagaagagaagaatatctttccaattagctttaatcagcaaaggcaaaaaatgcaaaacatcttttgtgatactttagttgatgaaaaaaaagccaagaagtggcctggatttcagacatacagcaccttagaaatatgtataattcatagcaaatcaccactatctatggttgccaagtaattgttgtgtacaaagaaatttagtggctttttatgacccagaaagtagaaggtataaaatgaaaatttaatatccattgcttcttttctagattttcattttttttaatttgccacattaaataattcacgagtcttttcttttcccccgtctcattcagtcttactcagggaaagccagttaaataagaagggaagtgtaaaactactaatttacagcttgaagggtttttttttttaagattgcttttctattttatctattaagcttgaaccagtttccatctggaaagattctaaaatataatagaaaataaattgaataatggtaattttaagcagtatatctatgaaatgtgttgtttgggattgatttcaatgtttctccccagcgtaaattttaaagttacatgcaatgattgatatagtttattatcagcaaaattatttctaatattattggcttacacaaactctagcaaaaattattttttcctcaatggaaaaagaaaagagaggaacagagttagaaagagaaaatgacttgaatcccaagtatcttcataccaaacatatcagggttccctgcatagtttgcagttgattgaggatttcacacgacttggcataaatttgattacatctctagactgtaacttttctgattgattatgcttcttttttatccatgtaatgtgttgccttttttaaaagaacaaatactacaataacgtgtgaagtggtcaatccctaagacatcaaagaaaggccacataaccctacccttctagtgctttgtgtgattgggtatcaaaggggttttcttcttctttttttgtttgtttgtttttctgttgcaaggccaatttatccattattggaaatgctaagcaagtggaatttactgttttgttaataaaatatttcttaatacaactgtgatttattgattttaaaaattatatgcggcaccatttcgtgcttaagtgggaaagtaaagaaggctgcatttgaagggaagacccatccttatattatagaggaagaatgttgactctcttttttctggatttaactagtcattaaagacctctatattcatacacttaaagatgtagccattaaatgtacttttgttatatttgttcatcttgatatgccagaaaccataaactcatacagtattagttgcaaacaatattaaaatactaatttcataaatatgctttttctctataaaagacaatggaatccaagttaagtaaacctgtgattaaattccaacactatcaca

SEQ ID NO: 243 - DNA, 9350 bp, Artificial Sequence
  NX1
ctctctctctctctctctctctctctttctttctttccgatggggaagagagggtggtgacaagttagaagcgcttgcggaaggtccccgcccccaggatcaggctccccctgcaaggggacgatgcaaaggtaaaagcacctcgctccgcagcatccagacctggaggggctgcgaccacgggccgagcccacccattccccagccaaaggacgggcccgccgctctccatggtactgcggagagctcagctccgcccttctctttcagaaggacagcacccggcgtcacgtaacccagccttctcaggctccaccaccgccttttccttcccagctctttccctctcctccccctcctcctccttctcctcctcctcctcctcctgctcccctccgttgcctgttctcccctcccgcactcctggagatagacgctcaagcctgacgcctctgaaaaggcagcagcagtcgccttatccatagacctcaggaaattcgctttgaccgatgcatgcttcaggctctggctcgagctgaggggaataaccgggcagatgtctgagtccttaaaaaagacaagataaaaccaaaatgcatcaccaacacacaaccaattgatgtgctggcatcttagcttggccctgcagaggcagagagaaaagaagaggagctgttgcgatttccacatctaacagcttctggctatttcgcaactgctgggtttgagtcctactgttgccgtggctgaaaagagaagtaaaatccaacttgtgagaccacgcacaaggaattaggctttggctgcagcggtgctgaagcccatgctatgacagaagaagcaggcctttgaagctatcctcgggttaagaaatggtgccctaaagaggcaagcatccctttctccgttctgctgtaagacaccacatctgaaggagacagacttgaggcattcacaagcatccaaggatactggctcactgctggcttcctgtactttcttgagaaaagtgttttctttttactgactctcactgcttccttttggcctggtaccactggtggaacctggcagataatgggatttgaggagttaagtatctgttgacactgcagatactcttaaattagttaatcagactcaaatgggtcagtgctttcccttgatcttttgttgaagccttttccagaacgttgtctccaaagtgcatcctccctttggtctggaagttctgtggctaccctgtaccactggggtcaacgttttccagttggaagaggactacagggagagagggcggggttattggaagaagaagaagaaaaaaagaactagataaaggagggcacatccctctcactcccgcctttccccttacctttctgtctctcgggacccttatttcttcgtcacggtgtccaggaccattttgaccctgtcggccccggcacccccccgccgcaccccagccccgagcatggggacggcgctgctccagcgcgggggctgttttcttctgtgcctctcgctgctgctcctgggctgctgggcggagctgggcagcgggctggagtttccgggcgccgagggccaatggacgcgcttccccaagtggaacgcctgctgcgagagcgagatgagcttccagctcaagactcgcagcgcccgcggcctcgtgctctacttcgacgacgagggcttctgcgacttcctggagctgattctgacgcgcggcggccgcctgcagctcagcttctccatcttctgcgctgagcctgcgacgctcctggccgacacgccggttaacgacggcgcctggcacagcgtgcgcatccgccgccagttccgcaacaccacgctcttcatcgaccaggtggaggccaagtgggtggaggtcaagtccaagcgcagggacatgacggtgttcagcggccttttcgtcggggggctgcccccggaactgcgcgccgcggcgctcaagctcaccctggcctcggtgagggagcgggagcccttcaaggggtggattcgtgacgtgagggtcaactcctcgcaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaagaagacaacaatgtggaaggtctggcgcacctgatgatgggcgaccaaggtaaaagtaaaggaaaagaagaatatattgccacgttcaaaggatctgaatacttctgctacgacttgtctcaaaaccccattcaaagcagcagtgatgaaataactctgtcatttaaaacccttcagaggaatggactgatgcttcacactgggaaatcggctgattatgtcaatcttgccctgaaaaatggagctgtctctctggtcattaatttgggatcaggggcctttgaagcactagtggagcctgtgaatggaaagtttaatgataatgcctggcatgatgtgaaagtcaccaggaatctgcgtcagcactcaggcattggacacgctatggtgacaatatcagtggatgggattcttaccacaacgggctacacgcaagaagattataccatgctggggtctgatgactttttctatgttggaggcagtcccagcacagccgaccttccagggtcaccagtcagtaacaactttatgggctgtctcaaagaggttgtatataaaaataatgatgtgaggctggaattatctcgacttgccaagcaaggagatcctaagatgaagatccatggagtggtggcatttaaatgtgagaatgttgcaactttagacccaatcacctttgaaaccccagagtctttcatctctttgcctaaatggaatgcaaagaaaactggctccatatcatttgatttccgtacaacagagccaaatggcctcatcttatttagccatggcaagccaagacatcagaaagatgccaagcacccacagatgataaaggtggacttctttgctattgagatgctagatggccacctctacctcctcctggacatggggtcaggtactataaaaataaaagccctgttgaagaaagtgaatgatggagaatggtatcatgtggacttccagagagacggacggtcaggtaccatttctgtcaacacgttgcgtactccctacactgctcctggtgagagtgagattctggacctggatgatgagttgtacctgggggggctgccagaaaataaagctggccttgtcttccccaccgaggtgtggactgctctgctcaactatggctacgtgggctgcatcagggatttgttcatcgatggccaaagcaaagatatccggcaaatggctgaagttcaaagtactgctggagtgaagccttcctgctcaaaggaaacagcaaaaccgtgccttagcaacccttgcaaaaacaatggcatgtgcagggatgggtggaacagatatgtctgtgattgttccggaacaggctatcttggcaggtcctgtgagagagaggcaacggttttgagctatgatgggagcatgtttatgaaaattcagctccccgtagtcatgcatacggaggctgaggatgtttccttacggttccgatcccagcgtgcatatggcattctgatggcaaccacttctagagactctgctgacaccctccgcctggagctagacgcaggacgtgtgaaactgacggtcaatctagattgtatcaggattaactgtaattccagcaaaggtcccgagactctttttgctggctataacctcaatgataacgagtggcacacagtgcgtgtagttcggcgtggaaaaagtttaaagttaacagtggatgaccaacaggccatgacaggtcaaatggcaggtgatcatactaggctggagttccataacatagagactggcatcatcacagaacgacggtatctttcttctgtcccctccaacttcattggacacctgcagagcttgacatttaatggaatggcatacattgacctgtgtaaaaatggcgacatagattactgtgagcttaatgccagatttggcttcaggaacatcatagcagatcctgtcaccttcaagaccaaatcgagctatgttgccttagctaccttgcaagcctacacttctatgcatctttttttccagttcaagacaacatccctagatggattaattctatataacagtggggatggaaatgactttattgtggttgaattagttaaagggtacttacattacgtgtttgatttgggaaatggtgctaacctcatcaaaggaagctcaaataaacctctcaatgacaatcagtggcacaacgtgatgatatcaagggacaccagcaacctccacactgtaaagattgacacaaaaatcacaacgcaaatcaccgccggagccaggaacttagacctcaagagtgacttatatataggaggagtagctaaagaaacatacaaatccttaccaaaacttgtacatgccaaagaaggctttcaaggctgcctggcatcagttgatttaaatggacggcttccggacctcatctccgatgctcttttctgcaacggacagatcgagagaggatgtgaagggcccagcacaacctgccaagaggactcatgttccaatcaaggtgtgtgcttgcaacaatgggatggcttcagctgtgactgtagtatgacttccttcagtggaccactctgcaatgaccctgggacgacatatatctttagcaaaggtggtggacaaatcacgtataagtggcctcctaatgaccgacccagtacacgagcagacagactggccataggttttagcactgttcagaaagaagccgtattggtgcgagtggacagttcttcaggcttgggtgactacctagaactgcatatacaccagggaaaaattggagttaagtttaatgttgggacagatgacatcgccattgaagaatccaatgcaatcattaatgatgggaaataccatgtagttcgtttcacgaggagtggtggcaatgccacgttgcaggtggacagctggccagtgatcgagcgctaccctgcagggcgtcagctcacaatcttcaatagccaagcaaccataataattggcgggaaagagcagggccagcccttccagggccagctctctgggctgtactacaatggcttgaaagttctgaatatggcagccgaaaacgatgccaacatcgccatagtgggaaatgtgagactggttggtgaagtgccttcctctatgacaactgagtcaacagccactgccatgcaatcagagatgtccacatcaattatggagactaccacgaccctggctactagcacagccagaagaggaaagcccccgacaaaagaacccattagccagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaacaaaaaacaaaaaacaggggccaataaattccctaacatccacagtgttttcatttactctgcttgtctttatgttgctggaacatttctaaaagacagtgatgaccgcacgcattcataaagcaaaggagtactacagcatcaaggcacaacacaaaaaccaacacaaaacataacacaaaaaagaagctacctatgatcctggatttagccaaagtgctagcgctttcctgagaagtcagtccaattgccagagaagactgtccttttgagtgactcaacctgcaaacctttaagagtttgccgcctggtgcaactggagcagtggttggaacttgcatttgaaacaaagtgctggcttttttgaagacttgtgtaggaacacattcaaaaagcccctttctggttgtgagagaggaaaaaaaagtatggaggccttattttcaaaaatgtgaaatataaggcacgttttcacacaaaatttcaaaacaaaaacaagagggcatagatgcaatcattgggaaattttcatgcacgcttattatgttattacatatgtttatataaaatccatctctgtgtgctttctggactgtgataagtgacgttttatagcctgttgtatagaaaatgcaaaatatatctctgctcttcagccatttttggtaaattcaatgttataagtgttgctaagtatagggagttttatgacatcagagcaacaattatttcagttgggtttttctttttttttgccaccattataaattgccacaattacttttattttttaaagaaattacagtgtagtgtttattctaaggaagatatgtatgaatgtatatacaaagactcagctacttcttttcttatatgtacagccttcattctgttgcaattaagttttagtacttgtatgaaaggtgtgaattagaaagtcacatatatacatatgtatcttataatcttttctccctgaaatactcacattcccacatacattcactattttcacacacacacacacacacacacacacacacacacacacacacacacgaatccacagcaatccatcagatatgctggaagatccaaacgtgcatacagtagcaaatatttattgacaaattgaaaagcaggaaggaagagggttgtgccaaggtattgatgacaaatggggtgatttgcttcattgagatcttgctcccaggtaaccttaagaagattttagtccctaaagaaatgaacctttccttatcaaatagaatatcactgatatactgctgcatgaataagaaccattatgtgggcaggttatggaagcaaaattggttaatctacaccttaactctggctgctgcaattgaaaactttctttctaataaaataatatatatatctctgaatctgatgtgcatgatgaacatttctggaaagtaaacactttctctcgactaagaaagtatttttcagtaatttttgattctgtattactacccacttaaaaaatcattctctgttaattattgactatgttttaacttttctggttttacatatatatcattaaatatagttttagtttaacacattaagtagtggaaaagtatagattatacacttgttttgcatattattcaatgatgttcacagcaataaattactaatatgagaaggtagtgcaaaaaatgcattattacattgcaagttgatgtttcaggaaaaattggttgcattacttgaataccttctaaaagaacgataaaaaattttgtagaagagaagaatatctttccaattagctttaatcagcaaaggcaaaaaatgcaaaacatcttttgtgatactttagttgatgaaaaaaaagccaagaagtggcctggatttcagacatacagcaccttagaaatatgtataattcatagcaaatcaccactatctatggttgccaagtaattgttgtgtacaaagaaatttagtggctttttatgacccagaaagtagaaggtataaaatgaaaatttaatatccattgcttcttttctagattttcattttttttaatttgccacattaaataattcacgagtcttttcttttcccccgtctcattcagtcttactcagggaaagccagttaaataagaagggaagtgtaaaactactaatttacagcttgaagggtttttttttttaagattgcttttctattttatctattaagcttgaaccagtttccatctggaaagattctaaaatataatagaaaataaattgaataatggtaattttaagcagtatatctatgaaatgtgttgtttgggattgatttcaatgtttctccccagcgtaaattttaaagttacatgcaatgattgatatagtttattatcagcaaaattatttctaatattattggcttacacaaactctagcaaaaattattttttcctcaatggaaaaagaaaagagaggaacagagttagaaagagaaaatgacttgaatcccaagtatcttcataccaaacatatcagggttccctgcatagtttgcagttgattgaggatttcacacgacttggcataaatttgattacatctctagactgtaacttttctgattgattatgcttcttttttatccatgtaatgtgttgccttttttaaaagaacaaatactacaataacgtgtgaagtggtcaatccctaagacatcaaagaaaggccacataaccctacccttctagtgctttgtgtgattgggtatcaaaggggttttcttcttctttttttgtttgtttgtttttctgttgcaaggccaatttatccattattggaaatgctaagcaagtggaatttactgttttgttaataaaatatttcttaatacaactgtgatttattgattttaaaaattatatgcggcaccatttcgtgcttaagtgggaaagtaaagaaggctgcatttgaagggaagacccatccttatattatagaggaagaatgttgactctcttttttctggatttaactagtcattaaagacctctatattcatacacttaaagatgtagccattaaatgtacttttgttatatttgttcatcttgatatgccagaaaccataaactcatacagtattagttgcaaacaatattaaaatactaatttcataaatatgctttttctctataaaagacaatggaatccaagttaagtaaacctgtgattaaattccaacactatcaca

SEQ ID NO: 244 - DNA, 5575 bp, Artificial Sequence
  NX1
ctttttttctttttctttttctttttctgtttctctcccttactccttcgtctgcatcttcttctcagctgcctttccgccgttcgattcccacttccttcagaagggcgcactcttccctctgaacccctcgccgggcgtaagtgtcaggaggcggcggacgcggagattgcctcgggagcaggcgatgcgcgccgctgctccgcgcgctgcccgggggaggctggcgctagcgggcgagccggccggggctgaatggagggaaggggcgcctggattccatggggtctgcttctgtcttgaaaggaggttgggccggcgaagtggcctccctagtccccgcacacaaagctaaatggatttacctagtggattcgcggtggatgtctgtcatgtagaagtgaggaccttccaggaggagctttaaacaatttctcggccccccacccgccggcacgcactctcgcccgaaactctttgggagtatctctcgagaacctggagccctggaaatctgggagcagccacccgctccgcgcttgctgttcccggggctgcctttccggacaagcccctctccagctgcattcgcctcggctatgtttcggattgtttggggtgctaggcacggcggactccaggaccccgagaagactgtccgaaggagggagaggatgggtgccctggcgcggtgaggcggccggcccctcagcccactccgcgccgcccgctcccctgcgccctctcctctccccgcgccccaaactttgcctcccgcggcggctgcccctcggcgggcgccccgccatgtaccagaggatgctccggtgcggcgccgagctgggctcgcccgggggcggcggcggcggcggcggcggcggcggcgcaggggggcgcctggccctgctttggatagtcccgctcaccctcagcggcctcctaggagtggcgtggggggcatccagtttgggagcgcaccacatccaccatttccatggcagcagcaagcatcattcagtgcctattgcaatctacaggtcaccggcatccttgcgaggcggacacgctgggacgacatatatctttagcaaaggtggtggacaaatcacgtataagtggcctcctaatgaccgacccagtacacgagcagacagactggccataggttttagcactgttcagaaagaagccgtattggtgcgagtggacagttcttcaggcttgggtgactacctagaactgcatatacaccagggaaaaattggagttaagtttaatgttgggacagatgacatcgccattgaagaatccaatgcaatcattaatgatgggaaataccatgtagttcgtttcacgaggagtggtggcaatgccacgttgcaggtggacagctggccagtgatcgagcgctaccctgcagggcgtcagctcacaatcttcaatagccaagcaaccataataattggcgggaaagagcagggccagcccttccagggccagctctctgggctgtactacaatggcttgaaagttctgaatatggcagccgaaaacgatgccaacatcgccatagtgggaaatgtgagactggttggtgaagtgccttcctctatgacaactgagtcaacagccactgccatgcaatcagagatgtccacatcaattatggagactaccacgaccctggctactagcacagccagaagaggaaagcccccgacaaaagaacccattagccagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaacaaaaaacaaaaaacaggggccaataaattccctaacatccacagtgttttcatttactctgcttgtctttatgttgctggaacatttctaaaagacagtgatgaccgcacgcattcataaagcaaaggagtactacagcatcaaggcacaacacaaaaaccaacacaaaacataacacaaaaaagaagctacctatgatcctggatttagccaaagtgctagcgctttcctgagaagtcagtccaattgccagagaagactgtccttttgagtgactcaacctgcaaacctttaagagtttgccgcctggtgcaactggagcagtggttggaacttgcatttgaaacaaagtgctggcttttttgaagacttgtgtaggaacacattcaaaaagcccctttctggttgtgagagaggaaaaaaaagtatggaggccttattttcaaaaatgtgaaatataaggcacgttttcacacaaaatttcaaaacaaaaacaagagggcatagatgcaatcattgggaaattttcatgcacgcttattatgttattacatatgtttatataaaatccatctctgtgtgctttctggactgtgataagtgacgttttatagcctgttgtatagaaaatgcaaaatatatctctgctcttcagccatttttggtaaattcaatgttataagtgttgctaagtatagggagttttatgacatcagagcaacaattatttcagttgggtttttctttttttttgccaccattataaattgccacaattacttttattttttaaagaaattacagtgtagtgtttattctaaggaagatatgtatgaatgtatatacaaagactcagctacttcttttcttatatgtacagccttcattctgttgcaattaagttttagtacttgtatgaaaggtgtgaattagaaagtcacatatatacatatgtatcttataatcttttctccctgaaatactcacattcccacatacattcactattttcacacacacacacacacacacacacacacacacacacacacacacacgaatccacagcaatccatcagatatgctggaagatccaaacgtgcatacagtagcaaatatttattgacaaattgaaaagcaggaaggaagagggttgtgccaaggtattgatgacaaatggggtgatttgcttcattgagatcttgctcccaggtaaccttaagaagattttagtccctaaagaaatgaacctttccttatcaaatagaatatcactgatatactgctgcatgaataagaaccattatgtgggcaggttatggaagcaaaattggttaatctacaccttaactctggctgctgcaattgaaaactttctttctaataaaataatatatatatctctgaatctgatgtgcatgatgaacatttctggaaagtaaacactttctctcgactaagaaagtatttttcagtaatttttgattctgtattactacccacttaaaaaatcattctctgttaattattgactatgttttaacttttctggttttacatatatatcattaaatatagttttagtttaacacattaagtagtggaaaagtatagattatacacttgttttgcatattattcaatgatgttcacagcaataaattactaatatgagaaggtagtgcaaaaaatgcattattacattgcaagttgatgtttcaggaaaaattggttgcattacttgaataccttctaaaagaacgataaaaaattttgtagaagagaagaatatctttccaattagctttaatcagcaaaggcaaaaaatgcaaaacatcttttgtgatactttagttgatgaaaaaaaagccaagaagtggcctggatttcagacatacagcaccttagaaatatgtataattcatagcaaatcaccactatctatggttgccaagtaattgttgtgtacaaagaaatttagtggctttttatgacccagaaagtagaaggtataaaatgaaaatttaatatccattgcttcttttctagattttcattttttttaatttgccacattaaataattcacgagtcttttcttttcccccgtctcattcagtcttactcagggaaagccagttaaataagaagggaagtgtaaaactactaatttacagcttgaagggtttttttttttaagattgcttttctattttatctattaagcttgaaccagtttccatctggaaagattctaaaatataatagaaaataaattgaataatggtaattttaagcagtatatctatgaaatgtgttgtttgggattgatttcaatgtttctccccagcgtaaattttaaagttacatgcaatgattgatatagtttattatcagcaaaattatttctaatattattggcttacacaaactctagcaaaaattattttttcctcaatggaaaaagaaaagagaggaacagagttagaaagagaaaatgacttgaatcccaagtatcttcataccaaacatatcagggttccctgcatagtttgcagttgattgaggatttcacacgacttggcataaatttgattacatctctagactgtaacttttctgattgattatgcttcttttttatccatgtaatgtgttgccttttttaaaagaacaaatactacaataacgtgtgaagtggtcaatccctaagacatcaaagaaaggccacataaccctacccttctagtgctttgtgtgattgggtatcaaaggggttttcttcttctttttttgtttgtttgtttttctgttgcaaggccaatttatccattattggaaatgctaagcaagtggaatttactgttttgttaataaaatatttcttaatacaactgtgatttattgattttaaaaattatatgcggcaccatttcgtgcttaagtgggaaagtaaagaaggctgcatttgaagggaagacccatccttatattatagaggaagaatgttgactctcttttttctggatttaactagtcattaaagacctctatattcatacacttaaagatgtagccattaaatgtacttttgttatatttgttcatcttgatatgccagaaaccataaactcatacagtattagttgcaaacaatattaaaatactaatttcataaatatgctttttctctataaaagacaatggaatccaagttaagtaaacctgtgattaaattccaacactatcaca

SEQ ID NO: 245 - protein, 1547 aa, Artificial Sequence
  NX1
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEIKFGLQCVLPVLLHDNDQGKYCCINTAKPLTEKDNNVEGLAHLMMGDQGKSKGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQHSGIGHAMVNKLHCSVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGNNDNERLAIARQRIPYRLGRVVDEWLLDKGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 246 - protein, 142 aa, Artificial Sequence
  NX1
MDMRWHCENLQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 247 - protein, 139 aa, Artificial Sequence
  NX1
MDMRWHCENLQTTDDILVASAECPSDDEDIDPCEPSSANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 248 - protein, 1477 aa, Artificial Sequence
  NX1
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQHSGIGHAMVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 249 - protein, 1462 aa, Artificial Sequence
  NX1
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQHSGIGHAMVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLMYQRMLRCGAELGSPGGGGGGGGGGGAGGRLALLWIVPLTLSGLLGVAWGASSLGAHHIHHFHGSSKHHSVPIAIYRSPASLRGGHAGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 250 - DNA, 2475 bp, Artificial Sequence
  CD83
gacgggggcgccccggcctaagcgggactaggagggcgcgccacccgcttccgctgcccgccggggaatcccccgggctggcgcgcagggaagttcccgaacgcgcgggcataaaagggcagccggcgcccgcgcgccacagctctgcagctcgtggcagcggcgcagcgctccagccatgtcgcgcggcctccagcttctgctcctgagctgcgcctacagcctggctcccgcgacgccggaggtgaaggtggcttgctccgaagatgtggacttgccctgcaccgccccctgggatccgcaggttccctacacggtctcctgggtcaagttattggagggtggtgaagagaggatggagacaccccaggaagaccacctcaggggacagcactatcatcagaaggggcaaaatggttctttcgacgcccccaatgaaaggccctattccctgaagatccgaaacactaccagctgcaactcggggacatacaggtgcactctgcaggacccggatgggcagagaaacctaagtggcaaggtgatcttgagagtgacaggatgccctgcacagcgtaaagaagagacttttaagaaatacagagcggagattgtcctgctgctggctctggttattttctacttaacactcatcattttcacttgttttgcacggctacagagtatcttcccagatttttctaaagctggcatggaacgagcttttctcccagttacctccccaaataagcatttagggctagtgactcctcacaagacagaactggtatgagcaggatttctgcaggttcttcttcctgaagctgaggctcaggggtgtgcctgtctgttacactggaggagagaagaatgagcctacgctgaagatggcatcctgtgaagtccttcacctcactgaaaacatctggaaggggatcccaccccattttctgtgggcaggcctcgaaaaccatcacatgaccacatagcatgaggccactgctgcttctccatggccaccttttcagcgatgtatgcagctatctggtcaacctcctggacattttttcagtcatataaaagctatggtgagatgcagctggaaaagggtcttgggaaatatgaatgcccccagctggcccgtgacagactcctgaggacagctgtcctcttctgcatcttggggacatctctttgaattttctgtgttttgctgtaccagcccagatgttttacgtctgggagaaattgacagatcaagctgtgagacagtgggaaatatttagcaaataatttcctggtgtgaaggtcctgctattactaaggagtaatctgtgtacaaagaaataacaagtcgatgaactattccccagcagggtcttttcatctgggaaagacatccataaagaagcaataaagaagagtgccacatttatttttatatctatatgtacttgtcaaagaaggtttgtgtttttctgcttttgaaatctgtatctgtagtgagatagcattgtgaactgacaggcagcctggacatagagagggagaagaagtcagagagggtgacaagatagagagctatttaatggccggctggaaatgctgggctgacggtgcagtctgggtgctcgcccacttgtcccactatctgggtgcatgatcttgagcaagttccttctggtgtctgctttctccattgtaaaccacaaggctgttgcatgggctaatgaagatcatatacgtgaaaattatttgaaaacatataaagcactatacagattcgaaactccattgagtcattatccttgctatgatgatggtgttttggggatgagagggtgctatccatttctcatgttttccattgtttgaaacaaagaaggttaccaagaagcctttcctgtagccttctgtaggaattcttttggggaagtgaggaagccaggtccacggtctgttcttgaagcagtagcctaacacactccaagatatggacacacgggagccgctggcagaagggacttcacgaagtgttgcatggatgttttagccattgttggctttcccttatcaaacttgggcccttcccttcttggtttccaaaggcattttattgcttgagttatatgttcactgtccccctaatattagggagtaaaacggataccaagttgatttagtgtttttacctctgtcttggctttcatgttattaaacgtatgcatgtgaagaaagggtgtttttctgttttatattcaactcataagactttgggataggaaaaatgagtaatggttactaggcttaatacctgggtgattacataatctgtacaatgaacccccatgatgtaagtttacctatgtaacaaacctgcacttatacccatgaacttaaaatgaaagttaaaaataaaaaacatatacaaataaaaaaatcccgactttgggatgagtgctaggatgttgtaaa

SEQ ID NO: 251 - DNA, 2307 bp, Artificial Sequence
  CD83
gattatcacagattctggagaagagtgaggacttgggttcaccacctacagcctggctcccgcgacgccggaggtgaaggtggcttgctccgaagatgtggacttgccctgcaccgccccctgggatccgcaggttccctacacggtctcctgggtcaagttattggagggtggtgaagagaggatggagacaccccaggaagaccacctcaggggacagcactatcatcagaaggggcaaaatggttctttcgacgcccccaatgaaaggccctattccctgaagatccgaaacactaccagctgcaactcggggacatacaggtgcactctgcaggacccggatgggcagagaaacctaagtggcaaggtgatcttgagagtgacaggatgccctgcacagcgtaaagaagagacttttaagaaatacagagcggagattgtcctgctgctggctctggttattttctacttaacactcatcattttcacttgtaagtttgcacggctacagagtatcttcccagatttttctaaagctggcatggaacgagcttttctcccagttacctccccaaataagcatttagggctagtgactcctcacaagacagaactggtatgagcaggatttctgcaggttcttcttcctgaagctgaggctcaggggtgtgcctgtctgttacactggaggagagaagaatgagcctacgctgaagatggcatcctgtgaagtccttcacctcactgaaaacatctggaaggggatcccaccccattttctgtgggcaggcctcgaaaaccatcacatgaccacatagcatgaggccactgctgcttctccatggccaccttttcagcgatgtatgcagctatctggtcaacctcctggacattttttcagtcatataaaagctatggtgagatgcagctggaaaagggtcttgggaaatatgaatgcccccagctggcccgtgacagactcctgaggacagctgtcctcttctgcatcttggggacatctctttgaattttctgtgttttgctgtaccagcccagatgttttacgtctgggagaaattgacagatcaagctgtgagacagtgggaaatatttagcaaataatttcctggtgtgaaggtcctgctattactaaggagtaatctgtgtacaaagaaataacaagtcgatgaactattccccagcagggtcttttcatctgggaaagacatccataaagaagcaataaagaagagtgccacatttatttttatatctatatgtacttgtcaaagaaggtttgtgtttttctgcttttgaaatctgtatctgtagtgagatagcattgtgaactgacaggcagcctggacatagagagggagaagaagtcagagagggtgacaagatagagagctatttaatggccggctggaaatgctgggctgacggtgcagtctgggtgctcgcccacttgtcccactatctgggtgcatgatcttgagcaagttccttctggtgtctgctttctccattgtaaaccacaaggctgttgcatgggctaatgaagatcatatacgtgaaaattatttgaaaacatataaagcactatacagattcgaaactccattgagtcattatccttgctatgatgatggtgttttggggatgagagggtgctatccatttctcatgttttccattgtttgaaacaaagaaggttaccaagaagcctttcctgtagccttctgtaggaattcttttggggaagtgaggaagccaggtccacggtctgttcttgaagcagtagcctaacacactccaagatatggacacacgggagccgctggcagaagggacttcacgaagtgttgcatggatgttttagccattgttggctttcccttatcaaacttgggcccttcccttcttggtttccaaaggcattttattgcttgagttatatgttcactgtccccctaatattagggagtaaaacggataccaagttgatttagtgtttttacctctgtcttggctttcatgttattaaacgtatgcatgtgaagaaagggtgtttttctgttttatattcaactcataagactttgggataggaaaaatgagtaatggttactaggcttaatacctgggtgattacataatctgtacaatgaacccccatgatgtaagtttacctatgtaacaaacctgcacttatacccatgaacttaaaatgaaagttaaaaataaaaaacatatacaaataaaaaaatcccgactttgggatgagtgctaggatgttgtaaa

SEQ ID NO: 252 - DNA, 2478 bp, Artificial Sequence
  CD83
gacgggggcgccccggcctaagcgggactaggagggcgcgccacccgcttccgctgcccgccggggaatcccccgggctggcgcgcagggaagttcccgaacgcgcgggcataaaagggcagccggcgcccgcgcgccacagctctgcagctcgtggcagcggcgcagcgctccagccatgtcgcgcggcctccagcttctgctcctgagctgcgcctacagcctggctcccgcgacgccggaggtgaaggtggcttgctccgaagatgtggacttgccctgcaccgccccctgggatccgcaggttccctacacggtctcctgggtcaagttattggagggtggtgaagagaggatggagacaccccaggaagaccacctcaggggacagcactatcatcagaaggggcaaaatggttctttcgacgcccccaatgaaaggccctattccctgaagatccgaaacactaccagctgcaactcggggacatacaggtgcactctgcaggacccggatgggcagagaaacctaagtggcaaggtgatcttgagagtgacaggatgccctgcacagcgtaaagaagagacttttaagaaatacagagcggagattgtcctgctgctggctctggttattttctacttaacactcatcattttcacttgtaagtttgcacggctacagagtatcttcccagatttttctaaagctggcatggaacgagcttttctcccagttacctccccaaataagcatttagggctagtgactcctcacaagacagaactggtatgagcaggatttctgcaggttcttcttcctgaagctgaggctcaggggtgtgcctgtctgttacactggaggagagaagaatgagcctacgctgaagatggcatcctgtgaagtccttcacctcactgaaaacatctggaaggggatcccaccccattttctgtgggcaggcctcgaaaaccatcacatgaccacatagcatgaggccactgctgcttctccatggccaccttttcagcgatgtatgcagctatctggtcaacctcctggacattttttcagtcatataaaagctatggtgagatgcagctggaaaagggtcttgggaaatatgaatgcccccagctggcccgtgacagactcctgaggacagctgtcctcttctgcatcttggggacatctctttgaattttctgtgttttgctgtaccagcccagatgttttacgtctgggagaaattgacagatcaagctgtgagacagtgggaaatatttagcaaataatttcctggtgtgaaggtcctgctattactaaggagtaatctgtgtacaaagaaataacaagtcgatgaactattccccagcagggtcttttcatctgggaaagacatccataaagaagcaataaagaagagtgccacatttatttttatatctatatgtacttgtcaaagaaggtttgtgtttttctgcttttgaaatctgtatctgtagtgagatagcattgtgaactgacaggcagcctggacatagagagggagaagaagtcagagagggtgacaagatagagagctatttaatggccggctggaaatgctgggctgacggtgcagtctgggtgctcgcccacttgtcccactatctgggtgcatgatcttgagcaagttccttctggtgtctgctttctccattgtaaaccacaaggctgttgcatgggctaatgaagatcatatacgtgaaaattatttgaaaacatataaagcactatacagattcgaaactccattgagtcattatccttgctatgatgatggtgttttggggatgagagggtgctatccatttctcatgttttccattgtttgaaacaaagaaggttaccaagaagcctttcctgtagccttctgtaggaattcttttggggaagtgaggaagccaggtccacggtctgttcttgaagcagtagcctaacacactccaagatatggacacacgggagccgctggcagaagggacttcacgaagtgttgcatggatgttttagccattgttggctttcccttatcaaacttgggcccttcccttcttggtttccaaaggcattttattgcttgagttatatgttcactgtccccctaatattagggagtaaaacggataccaagttgatttagtgtttttacctctgtcttggctttcatgttattaaacgtatgcatgtgaagaaagggtgtttttctgttttatattcaactcataagactttgggataggaaaaatgagtaatggttactaggcttaatacctgggtgattacataatctgtacaatgaacccccatgatgtaagtttacctatgtaacaaacctgcacttatacccatgaacttaaaatgaaagttaaaaataaaaaacatatacaaataaaaaaatcccgactttgggatgagtgctaggatgttgtaaa

SEQ ID NO: 253 - protein, 204 aa, Artificial Sequence
  CD83
MSRGLQLLLLSCAYSLAPATPEVKVACSEDVDLPCTAPWDPQVPYTVSWVKLLEGGEERMETPQEDHLRGQHYHQKGQNGSFDAPNERPYSLKIRNTTSCNSGTYRCTLQDPDGQRNLSGKVILRVTGCPAQRKEETFKKYRAEIVLLLALVIFYLTLIIFTCFARLQSIFPDFSKAGMERAFLPVTSPNKHLGLVTPHKTELV

SEQ ID NO: 254 - protein, 146 aa, Artificial Sequence
  CD83
METPQEDHLRGQHYHQKGQNGSFDAPNERPYSLKIRNTTSCNSGTYRCTLQDPDGQRNLSGKVILRVTGCPAQRKEETFKKYRAEIVLLLALVIFYLTLIIFTCKFARLQSIFPDFSKAGMERAFLPVTSPNKHLGLVTPHKTELV

SEQ ID NO: 255 - protein, 205 aa, Artificial Sequence
  CD83
MSRGLQLLLLSCAYSLAPATPEVKVACSEDVDLPCTAPWDPQVPYTVSWVKLLEGGEERMETPQEDHLRGQHYHQKGQNGSFDAPNERPYSLKIRNTTSCNSGTYRCTLQDPDGQRNLSGKVILRVTGCPAQRKEETFKKYRAEIVLLLALVIFYLTLIIFTCKFARLQSIFPDFSKAGMERAFLPVTSPNKHLGLVTPHKTELV

SEQ ID NO: 256 - DNA, 1322 bp, Artificial Sequence
  CD74
ctgcctggggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaacaaaaaaaaaaaaaaaaaa

SEQ ID NO: 257 - DNA, 1698 bp, Artificial Sequence
  CD74
ctgcctggggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagtactgaccaagtgccaggaagaggtcagccacatccctgctgtccacccgggttcattcaggcccaagtgcgacgagaacggcaactatctgccactccagtgctatgggagcatcggctactgctggtgtgtcttccccaacggcacggaggtccccaacaccagaagccgcgggcaccataactgcagtgagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaacaaaaaaaaaaaaaaaaaa

SEQ ID NO: 258 - DNA, 1506 bp, Artificial Sequence
  CD74
ctgcctggggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaacaaaaaaaaaaaaaaaaaa

SEQ ID NO: 259 - protein, 160 aa, Artificial Sequence
  CD74
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQSHWNWRTRLLGWV

SEQ ID NO: 260 - protein, 296 aa, Artificial Sequence
  CD74
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKVLTKCQEEVSHIPAVHPGSFRPKCDENGNYLPLQCYGSIGYCWCVFPNGTEVPNTRSRGHHNCSESLELEDPSSGLGVTKQDLGPVPM

SEQ ID NO: 261 - protein, 232 aa, Artificial Sequence
  CD74
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPM

SEQ ID NO: 262 - DNA, 5910 bp, Artificial Sequence
  IFI44L
aaagttagtggcagttggcatgctgccagctgagtttttttgctgctttgagtctcagttttctttctttcctagagtctctgaagccacagatctcttaagaactttctgtctccaaaccgtggctgctcgataaatcagacagaacagttaatcctcaatttaagcctgatctaacccctagaaacagatatagaacaatggaagtgacaacaagattgacatggaatgatgaaaatcatctgcgcaagctgcttggaaatgtttctttgagtcttctctataagtctagtgttcatggaggtagcattgaagatatggttgaaagatgcagccgtcagggatgtactataacaatggcttacattgattacaatatgattgtagcctttatgcttggaaattatattaatttacatgaaagttctacagagccaaatgattccctatggttttcacttcaaaagaaaaatgacaccactgaaatagaaactttactcttaaatacagcaccaaaaattattgatgagcaactggtgtgtcgtttatcgaaaacggatattttcattatatgtcgagataataaaatttatctagataaaatgataacaagaaacttgaaactaaggttttatggccaccgtcagtatttggaatgtgaagtttttcgagttgaaggaattaaggataacctagacgacataaagaggataattaaagccagagagcacagaaataggcttctagcagacatcagagactataggccctatgcagacttggtttcagaaattcgtattcttttggtgggtccagttgggtctggaaagtccagttttttcaattcagtcaagtctatttttcatggccatgtgactggccaagccgtagtggggtctgatatcaccagcataaccgagcggtataggatatattctgttaaagatggaaaaaatggaaaatctctgccatttatgttgtgtgacactatggggctagatggggcagaaggagcaggactgtgcatggatgacattccccacatcttaaaaggttgtatgccagacagatatcagtttaattcccgtaaaccaattacacctgagcattctacttttatcacctctccatctctgaaggacaggattcactgtgtggcttatgtcttagacatcaactctattgacaatctctactctaaaatgttggcaaaagtgaagcaagttcacaaagaagtattaaactgtggtatagcatatgtggccttgcttactaaagtggatgattgcagtgaggttcttcaagacaactttttaaacatgagtagatctatgacttctcaaagccgggtcatgaatgtccataaaatgctaggcattcctatttccaatattttgatggttggaaattatgcttcagatttggaactggaccccatgaaggatattctcatcctctctgcactgaggcagatgctgcgggctgcagatgattttttagaagatttgcctcttgaggaaactggtgcaattgagagagcgttacagccctgcatttgagataagttgccttgattctgacatttggcccagcctgtactggtgtgccgcaatgagagtcaatctctattgacagcctgcttcagattttgcttttgttcgttttgccttctgtccttggaacagtcatatctcaagttcaaaggccaaaacctgagaagcggtgggctaagataggtcctactgcaaaccacccctccatatttccgtaccatttacaattcagtttctgtgacatctttttaaaccactggaggaaaaatgagatattctctaatttattcttctataacactctatatagagctatgtgagtactaatcacattgaataatagttataaaattattgtatagacatctgcttcttaaacagattgtgagttctttgagaaacagcgtggattttacttatctgtgtattcacagagcttagcacagtgcctggtaatgagcaagcatacttgccattacttttccttcccactctctccaacatcacattcactttaaatttttctgtatatagaaaggaaaactagcctgggcaacatgatgaaaccccatctccactgcaaaaaaaaaaaaaaaaaataagaaagaacaaaacaaaccccacaaaaattagctgggtatgatggcacgtgcctgtagtcccagttactcaggatgattgattgagccttggaggtggaggctacagtgagctgagattgtgccactgtactctagccagggagaaagagtgagatcctggctcaaaaaaaccaaataaaacaaaacaaacaaacgaaaaacagaaaggaagactgaaagagaatgaaaagctggggagaggaaataaaaataaagaaggaagagtgtttcatttatatctgaatgaaaatatgaatgactctaagtaattgaattaattaaaatgagccaacttttttttaacaatttacattttatttctatgggaaaaaataaatattcctcttctaacaaacccatgcttgattttcattaattgaattccaaatcatcctagccatgtgtccttccatttaggttactggggcaaatcagtaagaaagttcttatatttatgctccaaataattctgaagtcctcttactagctgtgaaagctagtactattaagaaagaaaacaaaattcccaaaagatagctttcacttttttttttccttaaagacttcctaattctcttctccaaattcttagtcttcttcaaaataatatgctttggttcaatagttatccacattctgacagtctaatttagttttaatcagaattatactcatcttttgggtagtcatagatattaagaaagcaagagtttcttatgtccagttatggaatatttcctaaagcaaggctgcaggtgaagttgtgctcaagtgaatgttcaggagacacaattcagtggaagaaattaagtctttaaaaaagacctaggaataggagaaccatggaaattgaggaggtaggcctacaagtagatattgggaacaaaattagagaggcaaccagaaaaagttattttaggctcaccagagttgttcttattgcacagtaacacaccaatataccaaaacagcaggtattgcagtagagaaagagtttaataattgaatggcagaaaaatgaggaaggttgaggaaacctcaaatctacctccctgctgagtctaagtttaggatttttaagagaaaggcaggtaaggtgctgaaggtctggagctgctgatttgttggggtatagggaatgaaatgaaacatacagagatgaaaactggaagtttttttttgtttgttttgttttttttttgttgttgtttttttttttttttgtttttttgctgagtcaattccttggagggggtcttcagactgactggtgtcagcagacccatgggattccaagatctggaaaactttttagatagaaacttgatgtttcttaacgttacatatattatcttatagaaataactaagggaagttagtgccttgtgaccacatctatgtgacttttaggcagtaagaaactataaggaaaggagctaacagtcatgctgtaagtagctacagggaattggcttaaagggcaagttggttagtacttagctgtgtttttattcaaagtctacattttatgtagtggttaatgtttgctgttcattaggatggtttcacagttaccatacaaatgtagaagcaacaggtccaaaaagtagggcatgattttctccatgtaatccagggagaaaacaagccatgaccattgttggttgggagactgaaggtgattgaaggttcaccatcatcctcaccaacttttgggccataattcacccaaccctttggtggagcctgaaaaaaatctgggcagaatgtaggacttctttattttgtttaaaggggtaacacagagtgcccttatgaaggagttggagatcctgcaaggaagagaaggagtgaaggagagatcaagagagagaaacaatgaggaacatttcatttgacccaacatcctttaggagcataaatgttgacactaagttatcccttttgtgctaaaatggacagtattggcaaaatgataccacaacttcttattctctggctctatattgctttggaaacacttaaacatcaaatggagttaaatacatatttgaaatttaggttaggaaatattggtgaggaggcctcaaaaagggggaaacatcttttgtctgggaggatattttccattttgtggatttccctgatctttttctaccaccctgaggggtggtgggaattatcattttgctacattttagaggtcatccaggatttttgaaactttacattctttacggttaagcaagatgtacagctcagtcaaagacactaaattcttcttagaaaaatagtgctaaggagtatagcagatgacctatatgtgtgttggctgggagaatatcatcttaaagtgagagtgatgttgtggagacagttgaaatgtcaatgctagagcctctgtggtgtgaatgggcacgttaggttgttgcattagaaagtgactgtttctgacagaaatttgtagctttgtgcaaactcacccaccatctacctcaataaaatatagagaaaagaaaaatagagcagtttgagttctatgaggtatgcaggcccagagagacataagtatgttcctttagtcttgcttcctgtgtgccacactgcccctccacaaccatagctgggggcaattgtttaaagtcattttgttcccgactagctgccttgcacattatcttcattttcctggaatttgatacagagagcaatttatagccaattgatagcttatgctgtttcaatgtaaattcgtggtaaataacttaggaactgcctcttctttttctttgaaaacctacttataactgttgctaataagaatgtgtattgttcaggacaacttgtctccatacagttgggttgtaaccctcatgcttggcccaaataaactctctacttatatcagtttttcctacacttcttccttttaggtcaacaataccaagaggggttactgtgctgggtaatgtgtaaacttgtgtcttgtttagaaagataaatttaaagactatcacattgctttttcataaaacaagacaggtctacaattaatttattttgacgcaaattgataggggggccaagtaagccccatatgcttaatgatcagctgatgaataatcatctcctagcaacataactcaatctaatgctaaggtacccacaagatggcaaggctgatcaaagtcgtcatggaatcctgcaaccaaaagccatgggaatttggaagccctcaaatcccattcctaatctgatgagtctatggaccaatttgtggaggacagtagattaaatagatctgatttttgccatcaatgtaaggaggataaaaacttgcataccaattgtacacccttgcaaaatctttctctgatgttggagaaaatgggccagtgagatcatggatatagaagtacagtcaatgttcagctgtaccctcccacaatcccacttccttcctcaacacaattcaaacaaatagactcagactgtttcaggctccaggacaggaagtgcagtgtaggcaaaattgcaaaaattgagggcacaggggtggaggtgggggggttgaataacaagctgtgctaaataattacgtgtaaatatattttttcatttttaaaaattgatttcttttgcacattccatgacaatatatgtcacatttttaaaataaatgcaaagaagcatacatccaaaaaaaaaaaaaaaaa

SEQ ID NO: 263 - protein, 452 aa, Artificial Sequence
  IFI44L
MEVTTRLTWNDENHLRKLLGNVSLSLLYKSSVHGGSIEDMVERCSRQGCTITMAYIDYNMIVAFMLGNYINLHESSTEPNDSLWFSLQKKNDTTEIETLLLNTAPKIIDEQLVCRLSKTDIFIICRDNKIYLDKMITRNLKLRFYGHRQYLECEVFRVEGIKDNLDDIKRIIKAREHRNRLLADIRDYRPYADLVSEIRILLVGPVGSGKSSFFNSVKSIFHGHVTGQAVVGSDITSITERYRIYSVKDGKNGKSLPFMLCDTMGLDGAEGAGLCMDDIPHILKGCMPDRYQFNSRKPITPEHSTFITSPSLKDRIHCVAYVLDINSIDNLYSKMLAKVKQVHKEVLNCGIAYVALLTKVDDCSEVLQDNFLNMSRSMTSQSRVMNVHKMLGIPISNILMVGNYASDLELDPMKDILILSALRQMLRAADDFLEDLPLEETGAIERALQPCI

SEQ ID NO: 264 - DNA, 1048 bp, Artificial Sequence
  BST2
ataaaggggtggcccgtagaagattccagcaccctcccctaactccaggccagactcctttcagctaaaggggagatctggatggcatctacttcgtatgactattgcagagtgcccatggaagacggggataagcgctgtaagcttctgctggggataggaattctggtgctcctgatcatcgtgattctgggggtgcccttgattatcttcaccatcaaggccaacagcgaggcctgccgggacggccttcgggcagtgatggagtgtcgcaatgtcacccatctcctgcaacaagagctgaccgaggcccagaagggctttcaggatgtggaggcccaggccgccacctgcaaccacactgtgatggccctaatggcttccctggatgcagagaaggcccaaggacaaaagaaagtggaggagcttgagggagagatcactacattaaaccataagcttcaggacgcgtctgcagaggtggagcgactgagaagagaaaaccaggtcttaagcgtgagaatcgcggacaagaagtactaccccagctcccaggactccagctccgctgcggcgccccagctgctgattgtgctgctgggcctcagcgctctgctgcagtgagatcccaggaagctggcacatcttggaaggtccgtcctgctcggcttttcgcttgaacattcccttgatctcatcagttctgagcgggtcatggggcaacacggttagcggggagagcacggggtagccggagaagggcctctggagcaggtctggaggggccatggggaagtcctgggtgtggggacacagtcgggttgacccagggctgtctccctccagagcctccctccggacaatgagtcccccctcttgtctcccaccctgagattgggcatggggtgcggtgtggggggcatgtgctgcctgttgttatgggttttttttgcggggggggttgcttttttctggggtctttgagctccaaaaaataaacacttcctttgagggagagcacacctgaaaaaaaaaaaaaaaaaaaaaa

SEQ ID NO: 265 - protein, 180 aa, Artificial Sequence
  BST2
MASTSYDYCRVPMEDGDKRCKLLLGIGILVLLIIVILGVPLIIFTIKANSEACRDGLRAVMECRNVTHLLQQELTEAQKGFQDVEAQAATCNHTVMALMASLDAEKAQGQKKVEELEGEITTLNHKLQDASAEVERLRRENQVLSVRIADKKYYPSSQDSSSAAAPQLLIVLLGLSALLQ

SEQ ID NO: 266 - DNA, 685 bp, Artificial Sequence
  ISG15
ataatagggccggtgctgcctgccgaagccggcggctgagaggcagcgaactcatctttgccagtacaggagcttgtgccgtggcccacagcccacagcccacagccatgggctgggacctgacggtgaagatgctggcgggcaacgaattccaggtgtccctgagcagctccatgtcggtgtcagagctgaaggcgcagatcacccagaagatcggcgtgcacgccttccagcagcgtctggctgtccacccgagcggtgtggcgctgcaggacagggtcccccttgccagccagggcctgggccccggcagcacggtcctgctggtggtggacaaatgcgacgaacctctgagcatcctggtgaggaataacaagggccgcagcagcacctacgaggtacggctgacgcagaccgtggcccacctgaagcagcaagtgagcgggctggagggtgtgcaggacgacctgttctggctgaccttcgaggggaagcccctggaggaccagctcccgctgggggagtacggcctcaagcccctgagcaccgtgttcatgaatctgcgcctgcggggaggcggcacagagcctggcgggcggagctaagggcctccaccagcatccgagcaggatcaagggccggaaataaaggctgttgtaaagagaaaaaaaaaaaaaaaaaaaaa

SEQ ID NO: 267 - protein, 165 aa, Artificial Sequence
  ISG15
MGWDLTVKMLAGNEFQVSLSSSMSVSELKAQITQKIGVHAFQQRLAVHPSGVALQDRVPLASQGLGPGSTVLLVVDKCDEPLSILVRNNKGRSSTYEVRLTQTVAHLKQQVSGLEGVQDDLFWLTFEGKPLEDQLPLGEYGLKPLSTVFMNLRLRGGGTEPGGRS

SEQ ID NO: 268 - DNA, 4102 bp, Artificial Sequence
  CLIC6
agtttcagctgggcagaaggggcgcagaggcttggggccaagcggagtttgccctgcgggtcctgcgcaaggccccagtgccccggctaaacctttgccgcaggatcccggagccggcgtccttcaaggagcacagagggccccgtagcacgccccttgcccagcgccaccgacccttaagcagcgtcaaggaaggagtcccgatcaaggacagggatctgcggccatggccgaggccgcggagccggagggggttgccccgggtccccaggggccgccggaggtccccgcgcctctggctgagagacccggagagccaggagccgcgggcggggaggcagaagggccggaggggagcgagggcgcagaggaggcgccgaggggcgccgccgctgtgaaggaggcaggaggcggcgggccagacaggggcccggaggccgaggcgcggggcacgaggggggcgcacggcgagactgaggccgaggagggagccccggagggtgccgaggtgccccaaggaggggaggagacaagcggcgcgcagcaggtggagggggcgagcccgggacgcggcgcgcagggcgagccccgcggggaggctcagagggagcccgaggactctgcggcccccgagaggcaggaggaggcggagcagaggcctgaggtcccggaaggtagcgcgtccggggaggcgggggacagcgtagacgcggagggcccgctgggggacaacatagaagcggagggcccggcgggcgacagcgtagaggcggagggccgggtgggggacagcgtagacgcggaaggtccggcgggggacagcgtagacgcggagggcccgctgggggacaacatacaagccgagggcccggcgggggacagcgtagacgcggagggccgggtgggggacagcgtagacgcggaaggtccggcgggggacagcgtagacgcggagggccgggtgggggacagcgtagaggcgggggacccggcgggggacggcgtagaagcgggggtcccggcgggggacagcgtagaagccgaaggcccggcgggggacagcatggacgccgagggtccggcaggaagggcgcgccgggtctcgggtgagccgcagcaatcgggggacggcagcctctcgccccaggccgaggcaattgaggtcgcagccggggagagtgcggggcgcagccccggtgagctcgcctgggacgcagcggaggaggcggaggtcccgggggtaaaggggtccgaagaagcggcccccggggacgcaagggcagacgctggcgaggacagggtaggggatgggccacagcaggagccgggggaggacgaagagagacgagagcggagcccggaggggccaagggaggaggaagcagcggggggcgaagaggaatcccccgacagcagcccacatggggaggcctccaggggcgccgcggagcctgaggcccagctcagcaaccacctggccgaggagggccccgccgagggtagcggcgaggccgcgcgcgtgaacggccgccgggaggacggagaggcgtccgagccccgggccctggggcaggagcacgacatcaccctcttcgtcaaggtaaaacttactgcattaggctgttctcgcattgctataaagaaatacctgagagctggttatgatggtgagagtatcggaaattgcccgttttctcagcgtctctttatgattctctggctgaaaggcgttatatttaatgtgaccacagtggacctgaaaaggaaacccgcagacctgcagaacctggctcccggaacaaaccctcctttcatgacttttgatggtgaagtcaagacggatgtgaataagatcgaggagttcttagaggagaaattagctcccccgaggtatcccaagctggggacccaacatcccgaatctaattccgcaggaaatgacgtgtttgccaaattctcagcgtttataaaaaacacgaagaaggatgcaaatgagattcatgaaaagaacctgctgaaggccctgaggaagctggataattacttaaatagccctctgcctgatgaaatagatgcctacagcaccgaggatgtcactgtttctggaaggaagtttctggatggggacgagctgacgctggctgactgcaacctcttacccaagctccatattattaagattgtggccaagaagtacagagattttgaatttccttctgaaatgactggcatctggagatacttgaataatgcttatgctagagatgagttcacaaatacgtgtccagctgatcaagagattgaacacgcatattcagatgttgcaaaaagaatgaaatgaagctgggctgttttctgtcttatttctcagttgagtgagcaaggatacgaaaacagtgtgtttgaaaacaaattaggtttgggttcaattccttcaatttttaaaaaactggtctctgagagttttttaaatcattgagagcctgtttttcttctctaaaacattagtttaattttcttcaaaatgaaaatactgctttgtaattacaaaatgagacacacctatcttgatattttaaagcaatatcagagggtgtaaagaaggacattttaacaatcgccttcaattttactccacttaattaccgaaaacttactggagaacatgttccaaatcttcagtatcttgttctctctctctctctctctctctctctctatcacacacacacacacacacacacacacacacacacacaatttcattcatatatggtattgcattattttattttaaagcactggtgaggggacctcttggtgattcctggatgatcatacacagaggacttacaccatacaaaaatattgggcaccgcagtgccagagaagatgcttgaggttagattttaaggagtggggaattgtgaagcccacagatgcgcacgcaatgaccagcaggaaccggaagccctgggtcacccccactctgcctcatttctgcctccaggatgccactgcctctgcttccaggaaaggcaagggggagggtgcttatccgtgtctctggttccagcttcctgtctttgctccctcccctctcttagagactgtgccttcagcaggactcttaatatctgctgcaacttggagaacctccctgccctgaaatgtgaaccaagcacactttggttccttctccgggcggctctctctgagacccaaggctgcagtccctcagtgctggtggtatcgtgtggggatagcaatacttctctgcccttcattgtctcatctagacatcaagcagggaaaatccagggagattaaattcatggtgacaagtcctgggcagttctggtaaacggtccagttagggagggagtagaaactattgactcaaaagagtttctggctgatctgtggctttgcctccaccatccctaaccaacctctcatcacagctttgtgtgtgggctgagtgctggccttaaccctaggcgtggaagagaaaatgtgaggttgtttagatactcatcaggacctcacaggagctgagacttatcagccagaatgtgttcttcggacagtcgtacacatcttacagaaaaccctccttgtagagttggttgtggtatgtgtttgatgctataaagctcatttttaatgtgtacacctgctctagggacgattcgtttgaaagagagtaagatgcattaacagaaactatcctgggattaggtgaaaaatgtctagcaaaagaaacaaagtctttaatagagtggcctctttcgctcttcgattatgactgctgcagttttaccccagcagtcagctgtctttgtcaaccatacgtttttggagattgggtctagcacatgtcacccttgtccacgttgtttcacatctggttagggggcagattttaaaatgtagttttgtaatgttacatttaagcatgataaatgattagactaccagatgttactagtgctaactttgtattcttagacattaaaatgattgacataaactctttgtgccttgaaaatgaaacaaattataaaaatgtttaaatggaaccaaaaaaaaaaaaaaaaaa

SEQ ID NO: 269 - DNA, 4048 bp, Artificial Sequence
  CLIC6
agtttcagctgggcagaaggggcgcagaggcttggggccaagcggagtttgccctgcgggtcctgcgcaaggccccagtgccccggctaaacctttgccgcaggatcccggagccggcgtccttcaaggagcacagagggccccgtagcacgccccttgcccagcgccaccgacccttaagcagcgtcaaggaaggagtcccgatcaaggacagggatctgcggccatggccgaggccgcggagccggagggggttgccccgggtccccaggggccgccggaggtccccgcgcctctggctgagagacccggagagccaggagccgcgggcggggaggcagaagggccggaggggagcgagggcgcagaggaggcgccgaggggcgccgccgctgtgaaggaggcaggaggcggcgggccagacaggggcccggaggccgaggcgcggggcacgaggggggcgcacggcgagactgaggccgaggagggagccccggagggtgccgaggtgccccaaggaggggaggagacaagcggcgcgcagcaggtggagggggcgagcccgggacgcggcgcgcagggcgagccccgcggggaggctcagagggagcccgaggactctgcggcccccgagaggcaggaggaggcggagcagaggcctgaggtcccggaaggtagcgcgtccggggaggcgggggacagcgtagacgcggagggcccgctgggggacaacatagaagcggagggcccggcgggcgacagcgtagaggcggagggccgggtgggggacagcgtagacgcggaaggtccggcgggggacagcgtagacgcggagggcccgctgggggacaacatacaagccgagggcccggcgggggacagcgtagacgcggagggccgggtgggggacagcgtagacgcggaaggtccggcgggggacagcgtagacgcggagggccgggtgggggacagcgtagaggcgggggacccggcgggggacggcgtagaagcgggggtcccggcgggggacagcgtagaagccgaaggcccggcgggggacagcatggacgccgagggtccggcaggaagggcgcgccgggtctcgggtgagccgcagcaatcgggggacggcagcctctcgccccaggccgaggcaattgaggtcgcagccggggagagtgcggggcgcagccccggtgagctcgcctgggacgcagcggaggaggcggaggtcccgggggtaaaggggtccgaagaagcggcccccggggacgcaagggcagacgctggcgaggacagggtaggggatgggccacagcaggagccgggggaggacgaagagagacgagagcggagcccggaggggccaagggaggaggaagcagcggggggcgaagaggaatcccccgacagcagcccacatggggaggcctccaggggcgccgcggagcctgaggcccagctcagcaaccacctggccgaggagggccccgccgagggtagcggcgaggccgcgcgcgtgaacggccgccgggaggacggagaggcgtccgagccccgggccctggggcaggagcacgacatcaccctcttcgtcaaggctggttatgatggtgagagtatcggaaattgcccgttttctcagcgtctctttatgattctctggctgaaaggcgttatatttaatgtgaccacagtggacctgaaaaggaaacccgcagacctgcagaacctggctcccggaacaaaccctcctttcatgacttttgatggtgaagtcaagacggatgtgaataagatcgaggagttcttagaggagaaattagctcccccgaggtatcccaagctggggacccaacatcccgaatctaattccgcaggaaatgacgtgtttgccaaattctcagcgtttataaaaaacacgaagaaggatgcaaatgagattcatgaaaagaacctgctgaaggccctgaggaagctggataattacttaaatagccctctgcctgatgaaatagatgcctacagcaccgaggatgtcactgtttctggaaggaagtttctggatggggacgagctgacgctggctgactgcaacctcttacccaagctccatattattaagattgtggccaagaagtacagagattttgaatttccttctgaaatgactggcatctggagatacttgaataatgcttatgctagagatgagttcacaaatacgtgtccagctgatcaagagattgaacacgcatattcagatgttgcaaaaagaatgaaatgaagctgggctgttttctgtcttatttctcagttgagtgagcaaggatacgaaaacagtgtgtttgaaaacaaattaggtttgggttcaattccttcaatttttaaaaaactggtctctgagagttttttaaatcattgagagcctgtttttcttctctaaaacattagtttaattttcttcaaaatgaaaatactgctttgtaattacaaaatgagacacacctatcttgatattttaaagcaatatcagagggtgtaaagaaggacattttaacaatcgccttcaattttactccacttaattaccgaaaacttactggagaacatgttccaaatcttcagtatcttgttctctctctctctctctctctctctctctatcacacacacacacacacacacacacacacacacacacaatttcattcatatatggtattgcattattttattttaaagcactggtgaggggacctcttggtgattcctggatgatcatacacagaggacttacaccatacaaaaatattgggcaccgcagtgccagagaagatgcttgaggttagattttaaggagtggggaattgtgaagcccacagatgcgcacgcaatgaccagcaggaaccggaagccctgggtcacccccactctgcctcatttctgcctccaggatgccactgcctctgcttccaggaaaggcaagggggagggtgcttatccgtgtctctggttccagcttcctgtctttgctccctcccctctcttagagactgtgccttcagcaggactcttaatatctgctgcaacttggagaacctccctgccctgaaatgtgaaccaagcacactttggttccttctccgggcggctctctctgagacccaaggctgcagtccctcagtgctggtggtatcgtgtggggatagcaatacttctctgcccttcattgtctcatctagacatcaagcagggaaaatccagggagattaaattcatggtgacaagtcctgggcagttctggtaaacggtccagttagggagggagtagaaactattgactcaaaagagtttctggctgatctgtggctttgcctccaccatccctaaccaacctctcatcacagctttgtgtgtgggctgagtgctggccttaaccctaggcgtggaagagaaaatgtgaggttgtttagatactcatcaggacctcacaggagctgagacttatcagccagaatgtgttcttcggacagtcgtacacatcttacagaaaaccctccttgtagagttggttgtggtatgtgtttgatgctataaagctcatttttaatgtgtacacctgctctagggacgattcgtttgaaagagagtaagatgcattaacagaaactatcctgggattaggtgaaaaatgtctagcaaaagaaacaaagtctttaatagagtggcctctttcgctcttcgattatgactgctgcagttttaccccagcagtcagctgtctttgtcaaccatacgtttttggagattgggtctagcacatgtcacccttgtccacgttgtttcacatctggttagggggcagattttaaaatgtagttttgtaatgttacatttaagcatgataaatgattagactaccagatgttactagtgctaactttgtattcttagacattaaaatgattgacataaactctttgtgccttgaaaatgaaacaaattataaaaatgtttaaatggaaccaaaaaaaaaaaaaaaaaa

SEQ ID NO: 270 - protein, 704 aa, Artificial Sequence
  CLIC6
MAEAAEPEGVAPGPQGPPEVPAPLAERPGEPGAAGGEAEGPEGSEGAEEAPRGAAAVKEAGGGGPDRGPEAEARGTRGAHGETEAEEGAPEGAEVPQGGEETSGAQQVEGASPGRGAQGEPRGEAQREPEDSAAPERQEEAEQRPEVPEGSASGEAGDSVDAEGPLGDNIEAEGPAGDSVEAEGRVGDSVDAEGPAGDSVDAEGPLGDNIQAEGPAGDSVDAEGRVGDSVDAEGPAGDSVDAEGRVGDSVEAGDPAGDGVEAGVPAGDSVEAEGPAGDSMDAEGPAGRARRVSGEPQQSGDGSLSPQAEAIEVAAGESAGRSPGELAWDAAEEAEVPGVKGSEEAAPGDARADAGEDRVGDGPQQEPGEDEERRERSPEGPREEEAAGGEEESPDSSPHGEASRGAAEPEAQLSNHLAEEGPAEGSGEAARVNGRREDGEASEPRALGQEHDITLFVKVKLTALGCSRIAIKKYLRAGYDGESIGNCPFSQRLFMILWLKGVIFNVTTVDLKRKPADLQNLAPGTNPPFMTFDGEVKTDVNKIEEFLEEKLAPPRYPKLGTQHPESNSAGNDVFAKFSAFIKNTKKDANEIHEKNLLKALRKLDNYLNSPLPDEIDAYSTEDVTVSGRKFLDGDELTLADCNLLPKLHIIKIVAKKYRDFEFPSEMTGIWRYLNNAYARDEFTNTCPADQEIEHAYSDVAKRMK

SEQ ID NO: 271 - protein, 686 aa, Artificial Sequence
  CLIC6
MAEAAEPEGVAPGPQGPPEVPAPLAERPGEPGAAGGEAEGPEGSEGAEEAPRGAAAVKEAGGGGPDRGPEAEARGTRGAHGETEAEEGAPEGAEVPQGGEETSGAQQVEGASPGRGAQGEPRGEAQREPEDSAAPERQEEAEQRPEVPEGSASGEAGDSVDAEGPLGDNIEAEGPAGDSVEAEGRVGDSVDAEGPAGDSVDAEGPLGDNIQAEGPAGDSVDAEGRVGDSVDAEGPAGDSVDAEGRVGDSVEAGDPAGDGVEAGVPAGDSVEAEGPAGDSMDAEGPAGRARRVSGEPQQSGDGSLSPQAEAIEVAAGESAGRSPGELAWDAAEEAEVPGVKGSEEAAPGDARADAGEDRVGDGPQQEPGEDEERRERSPEGPREEEAAGGEEESPDSSPHGEASRGAAEPEAQLSNHLAEEGPAEGSGEAARVNGRREDGEASEPRALGQEHDITLFVKAGYDGESIGNCPFSQRLFMILWLKGVIFNVTTVDLKRKPADLQNLAPGTNPPFMTFDGEVKTDVNKIEEFLEEKLAPPRYPKLGTQHPESNSAGNDVFAKFSAFIKNTKKDANEIHEKNLLKALRKLDNYLNSPLPDEIDAYSTEDVTVSGRKFLDGDELTLADCNLLPKLHIIKIVAKKYRDFEFPSEMTGIWRYLNNAYARDEFTNTCPADQEIEHAYSDVAKRMK

SEQ ID NO: 272 - DNA, 2825 bp, Artificial Sequence
  PBX3
ctctgcacaggagcggacgcgggagcccctccgcacccgtcccctcccccgggtcgccttcgcctgcccccggggcgaggctccccgcgcgggttcgcgtcgcgtctgcagtggccgaggctgctgcctgccgggcagatgggtccgccttgttccggctgcagctttcgccgccggggcttgctggctgtcgggaactagtcaactggagtttttgttgacttcccacggaaacatgccctgaactgtcacagaatgaaaccagcgctcttcagcgtcctgtgtgagatcaaagagaaaacaggtctcagcatcagaggagcccaggaggaggaccctcccgatccccagctaatgagactggacaatatgcttttggcagaaggggtttcaggtcctgagaaaggtgggggatcggcggcagcagctgcagccgcggcagcctctggaggttcttcagataactctattgaacactcagattacagagccaaattgacccagatcagacaaatctatcacacagaactggagaaatatgaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactcacacctcagcaacccctaccccagtgaagaagccaaagaggagctggccaagaaatgcagcatcacagtgtcacaggtatccaattggtttggcaacaaacgaatcaggtacaagaagaacattggcaagtttcaggaagaagccaacctctatgctgcaaagacggccgtgacagctgcacacgcagtagcagcagctgtgcagaacaaccagaccaattcgcccaccacaccaaattccggttcttctggttcttttaacctcccaaattctggggacatgttcatgaacatgcagagtctgaatggggattcttaccaagggtcccaagtcggagccaatgtgcaatcacaggtggataccctccgtcatgttatcaatcagacgggaggctacagtgatggccttggaggaaattcactgtacagtccacataatttaaatgctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaaggaaagcgtttttgtagcccaccatctacagctttactgtaaaaccttgtcttattcgagaacttggtaaatctgttttttaaggaatcataatcatttgtatttatacttaaaaacacacaatgttaaaaaaaataaagcactttatccaattaggccaagatttaacattgttgacagtcctgtagctattttatcataatttattatcaatattttacattaatggtttcacagttgccaattacttggccttaagggtaaaaagtacaatatacactaaacctcaaccgttaaagcagatgcaaaaattcacctcacctaaattgaacttcttgcatatttccattactgacttggattgtctttctttcatatcactaatggagttggaataaagagctgtttgcctatccctgttaatgatggttgtgtttaagaatcttcctcgtcacgtttgtgttcagatctcttatgttataattagatcagagactggtagcatcgtttctctctctgaaagcaccagtgcccagagtctgctcggtaataaaattatggatccagattgttctgagagacgaagatacttgctgctgatagaggtgaaaacgagattgatccgtctggggttttacggtgtgcactgggtgctgcacagacttgtcaaggtttgctacgtcctctgggcatctgcaaaaggccctgctctctggagtgttgtatatagtgtagcaaaagagtatttatacatcccaccaatcaaaacacagctttattacctcatgcgaactcatacaaaccaatagaatttcaacatgttctgtagcttagagtgctcacttactacctctgaacaatactcacgctgtagtttgtctctttcttatctttttgcatcttgtaattaactctttgtttcccttcataaaatgtaatgtacattgtaatcttttaaaagaaaaatcagggttgcacttgcaacttttaaaaaaccgagtgtggaaacattgggtcttaattcaacacaggatcggtaaaactgttgtaaatactgagaaacattttgaatgttcttcatcttattactaatccatgcaaaaaaaaaaaaaaaagcagcgactaattgtgatgcattcagatttcagtattcagtactgtatatttcaccctgtgtaatggggccccctctcctttctctctttttgtattgtatgcgattctgaaactgattgagtcatgaaaataatttgtggcggtgattctaatgtattaaaaacgtttcgtgttcctttctaactggattacaccctggattgaaaaagtcttcctcgtggtagttatatgtagtttcaaacatgaataaactttttgctttcatgattaaaaaaaaaaaaaaaaaaaaaaaaaaaaaaaaaaaaaaa

SEQ ID NO: 273 - DNA, 2911 bp, Artificial Sequence
  PBX3
gcggccgcctccccctccccctccccctctttcttctcctccctcgtcgccgccgccgccgccgccgcctcagccttcgcctcagccgccgcccgctcccgcccgcgcgcggcgggatggacgatcaatccaggatgctgcagactctggccggggtgaacctggctggccactcggtgcaggggggcatggccctgccgcctcccccgcacggccacgaaggggcggacggcgacggcaggaagcaggacatcggcgacatcctccaccagatcatgaccatcaccgaccagagcttggacgaggcgcaagcaaagaaacatgccctgaactgtcacagaatgaaaccagcgctcttcagcgtcctgtgtgagatcaaagagaaaacaggtctcagcatcagaggagcccaggaggaggaccctcccgatccccagctaatgagactggacaatatgcttttggcagaaggggtttcaggtcctgagaaaggtgggggatcggcggcagcagctgcagccgcggcagcctctggaggttcttcagataactctattgaacactcagattacagagccaaattgacccagatcagacaaatctatcacacagaactggagaaatatgaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactcacacctcagcaacccctaccccagtgaagaagccaaagaggagctggccaagaaatgcagcatcacagtgtcacaggtatccaattggtttggcaacaaacgaatcaggtacaagaagaacattggcaagtttcaggaagaagccaacctctatgctgcaaagacggccgtgacagctgcacacgcagtagcagcagctgtgcagaacaaccagaccaattcgcccaccacaccaaattccggttcttctggttcttttaacctcccaaattctggggacatgttcatgaacatgcagagtctgaatggggattcttaccaagggtcccaagtcggagccaatgtgcaatcacaggtggataccctccgtcatgttatcaatcagacgggaggctacagtgatggccttggaggaaattcactgtacagtccacataatttaaatgctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaaggaaagcgtttttgtagcccaccatctacagctttactgtaaaaccttgtcttattcgagaacttggtaaatctgttttttaaggaatcataatcatttgtatttatacttaaaaacacacaatgttaaaaaaaataaagcactttatccaattaggccaagatttaacattgttgacagtcctgtagctattttatcataatttattatcaatattttacattaatggtttcacagttgccaattacttggccttaagggtaaaaagtacaatatacactaaacctcaaccgttaaagcagatgcaaaaattcacctcacctaaattgaacttcttgcatatttccattactgacttggattgtctttctttcatatcactaatggagttggaataaagagctgtttgcctatccctgttaatgatggttgtgtttaagaatcttcctcgtcacgtttgtgttcagatctcttatgttataattagatcagagactggtagcatcgtttctctctctgaaagcaccagtgcccagagtctgctcggtaataaaattatggatccagattgttctgagagacgaagatacttgctgctgatagaggtgaaaacgagattgatccgtctggggttttacggtgtgcactgggtgctgcacagacttgtcaaggtttgctacgtcctctgggcatctgcaaaaggccctgctctctggagtgttgtatatagtgtagcaaaagagtatttatacatcccaccaatcaaaacacagctttattacctcatgcgaactcatacaaaccaatagaatttcaacatgttctgtagcttagagtgctcacttactacctctgaacaatactcacgctgtagtttgtctctttcttatctttttgcatcttgtaattaactctttgtttcccttcataaaatgtaatgtacattgtaatcttttaaaagaaaaatcagggttgcacttgcaacttttaaaaaaccgagtgtggaaacattgggtcttaattcaacacaggatcggtaaaactgttgtaaatactgagaaacattttgaatgttcttcatcttattactaatccatgcaaaaaaaaaaaaaaaagcagcgactaattgtgatgcattcagatttcagtattcagtactgtatatttcaccctgtgtaatggggccccctctcctttctctctttttgtattgtatgcgattctgaaactgattgagtcatgaaaataatttgtggcggtgattctaatgtattaaaaacgtttcgtgttcctttctaactggattacaccctggattgaaaaagtcttcctcgtggtagttatatgtagtttcaaacatgaataaactttttgctttcatgattaaaaaaaaaaaaaaaaaaaaaaaaaaaaaaaaaaaaaaa

SEQ ID NO: 274 - protein, 359 aa, Artificial Sequence
  PBX3
MKPALFSVLCEIKEKTGLSIRGAQEEDPPDPQLMRLDNMLLAEGVSGPEKGGGSAAAAAAAAASGGSSDNSIEHSDYRAKLTQIRQIYHTELEKYEQACNEFTTHVMNLLREQSRTRPISPKEIERMVGIIHRKFSSIQMQLKQSTCEAVMILRSRFLDARRKRRNFSKQATEILNEYFYSHLSNPYPSEEAKEELAKKCSITVSQVSNWFGNKRIRYKKNIGKFQEEANLYAAKTAVTAAHAVAAAVQNNQTNSPTTPNSGSSGSFNLPNSGDMFMNMQSLNGDSYQGSQVGANVQSQVDTLRHVINQTGGYSDGLGGNSLYSPHNLNANGGWQDATTPSSVTSPTEGPGSVHSDTSN

SEQ ID NO: 275 - protein, 434 aa, Artificial Sequence
  PBX3
MDDQSRMLQTLAGVNLAGHSVQGGMALPPPPHGHEGADGDGRKQDIGDILHQIMTITDQSLDEAQAKKHALNCHRMKPALFSVLCEIKEKTGLSIRGAQEEDPPDPQLMRLDNMLLAEGVSGPEKGGGSAAAAAAAAASGGSSDNSIEHSDYRAKLTQIRQIYHTELEKYEQACNEFTTHVMNLLREQSRTRPISPKEIERMVGIIHRKFSSIQMQLKQSTCEAVMILRSRFLDARRKRRNFSKQATEILNEYFYSHLSNPYPSEEAKEELAKKCSITVSQVSNWFGNKRIRYKKNIGKFQEEANLYAAKTAVTAAHAVAAAVQNNQTNSPTTPNSGSSGSFNLPNSGDMFMNMQSLNGDSYQGSQVGANVQSQVDTLRHVINQTGGYSDGLGGNSLYSPHNLNANGGWQDATTPSSVTSPTEGPGSVHSDTSN

SEQ ID NO: 276 - DNA, 2433 bp, Artificial Sequence
  TOX2
gattgaacagcgcgcgtgggtttcccgcagccctggcgcagacgcgtgggctccgtggcgatgcgggtttgatggtgacagtgcctacgtggggatgagtgacggaaacccagagctcctgtcaaccagccagacctacaacggccagagcgagaacaacgaagactatgagatccccccgataacacctcccaacctcccggagccatccctcctgcacctgggggaccacgaagccagctaccactcgctgtgccacggcctcacccccaacggtctgctccctgcctactcctatcaggccatggacctcccagccatcatggtgtccaacatgctagcacaggacagccacctgctgtcgggccagctgcccacgatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcaggcctacaagaggaagacagaagcagcaaagaaggaatatctgaaggccctggcagcctaccgggctagcctcgtctccaagagctccccagatcaaggtgagaccaagagcactcaggcaaacccaccagccaaaatgctcccacccaagcagcccatgtatgccatgccaggcctggcctccttcctgacgccgtcggacctgcaggccttccgcagtggggcctcccctgccagcctcgcccggacgctgggctccaagtctctgctgccaggcctcagtgcgtccccgccgccgccaccctccttcccgctcagccccacactgcaccagcagctgtcactgccccctcacgcccagggcgccctcctcagtccacctgttagcatgtccccagccccccagccccctgtcctgcccacccccatggcactccaggtgcagctggcgatgagcccctcacctccagggccacaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggccgcccctggcggggtcgcttaccaacggacacccaccccagatgcatgggccagagggccggcccccggcatagatgtgcacatcggttttccagtgtgaacaaaagattacgaaacctagaaactgttggttccgtgtaagtagttgactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaagttacagcttatcctaccgtgtgtgtggttttggggtttcgtttgggtttgggttcttgacgtcgtttgcagctgtttcctggccctggcgagtgtctgtcttggtgcccagtgcttctctcaaatctctttataataaaacttctgaaaagctgaaaaaaaaaaaaaaaaaa

SEQ ID NO: 277 - DNA, 2505 bp, Artificial Sequence
  TOX2
actgcccgcgggagccgccgccgccgccgccgcgcccgccatggacgtccgcctgtacccctcggcgcccgcggtgggcgcgcggcccggggccgagccggccggcctggcgcacctggactattaccacggcggcaagtttgatggtgacagtgcctacgtggggatgagtgacggaaacccagagctcctgtcaaccagccagacctacaacggccagagcgagaacaacgaagactatgagatccccccgataacacctcccaacctcccggagccatccctcctgcacctgggggaccacgaagccagctaccactcgctgtgccacggcctcacccccaacggtctgctccctgcctactcctatcaggccatggacctcccagccatcatggtgtccaacatgctagcacaggacagccacctgctgtcgggccagctgcccacgatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcaggcctacaagaggaagacagaagcagcaaagaaggaatatctgaaggccctggcagcctaccgggctagcctcgtctccaagagctccccagatcaaggtgagaccaagagcactcaggcaaacccaccagccaaaatgctcccacccaagcagcccatgtatgccatgccaggcctggcctccttcctgacgccgtcggacctgcaggccttccgcagtggggcctcccctgccagcctcgcccggacgctgggctccaagtctctgctgccaggcctcagtgcgtccccgccgccgccaccctccttcccgctcagccccacactgcaccagcagctgtcactgccccctcacgcccagggcgccctcctcagtccacctgttagcatgtccccagccccccagccccctgtcctgcccacccccatggcactccaggtgcagctggcgatgagcccctcacctccagggccacaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggccgcccctggcggggtcgcttaccaacggacacccaccccagatgcatgggccagagggccggcccccggcatagatgtgcacatcggttttccagtgtgaacaaaagattacgaaacctagaaactgttggttccgtgtaagtagttgactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaagttacagcttatcctaccgtgtgtgtggttttggggtttcgtttgggtttgggttcttgacgtcgtttgcagctgtttcctggccctggcgagtgtctgtcttggtgcccagtgcttctctcaaatctctttataataaaacttctgaaaagctgaaaaaaaaaaaaaaaaaa

SEQ ID NO: 278 - DNA, 2428 bp, Artificial Sequence
  TOX2
ctctttctctgctgattatgcagcagactcgcacagaggctgtcgcgggcgcgttctctcgctgcctgggcttctgtggaatgagactcgggctccttctacttgcaagacactggtgcattgcaggtgtgtttccgcagaagtttgatggtgacagtgcctacgtggggatgagtgacggaaacccagagctcctgtcaaccagccagacctacaacggccagagcgagaacaacgaagactatgagatccccccgataacacctcccaacctcccggagccatccctcctgcacctgggggaccacgaagccagctaccactcgctgtgccacggcctcacccccaacggtctgctccctgcctactcctatcaggccatggacctcccagccatcatggtgtccaacatgctagcacaggacagccacctgctgtcgggccagctgcccacgatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcagagctccccagatcaaggtgagaccaagagcactcaggcaaacccaccagccaaaatgctcccacccaagcagcccatgtatgccatgccaggcctggcctccttcctgacgccgtcggacctgcaggccttccgcagtggggcctcccctgccagcctcgcccggacgctgggctccaagtctctgctgccaggcctcagtgcgtccccgccgccgccaccctccttcccgctcagccccacactgcaccagcagctgtcactgccccctcacgcccagggcgccctcctcagtccacctgttagcatgtccccagccccccagccccctgtcctgcccacccccatggcactccaggtgcagctggcgatgagcccctcacctccagggccacaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggccgcccctggcggggtcgcttaccaacggacacccaccccagatgcatgggccagagggccggcccccggcatagatgtgcacatcggttttccagtgtgaacaaaagattacgaaacctagaaactgttggttccgtgtaagtagttgactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaagttacagcttatcctaccgtgtgtgtggttttggggtttcgtttgggtttgggttcttgacgtcgtttgcagctgtttcctggccctggcgagtgtctgtcttggtgcccagtgcttctctcaaatctctttataataaaacttctgaaaagctgaaaaaaaaaaaaaaaaaa

SEQ ID NO: 279 - DNA, 2558 bp, Artificial Sequence
  TOX2
gattgaacagcgcgcgtgggtttcccgcagccctggcgcagacgcgtgggctccgtggcgatgcggggtgttgcctgaggctccactgaagctatggcataatttgcagaatttgcacttcattacttttctgaaattcaaacaaattctgaaactgcacgagttctggctgagagctgtggatctgtgcattttgatggtgacagtgcctacgtggggatgagtgacggaaacccagagctcctgtcaaccagccagacctacaacggccagagcgagaacaacgaagactatgagatccccccgataacacctcccaacctcccggagccatccctcctgcacctgggggaccacgaagccagctaccactcgctgtgccacggcctcacccccaacggtctgctccctgcctactcctatcaggccatggacctcccagccatcatggtgtccaacatgctagcacaggacagccacctgctgtcgggccagctgcccacgatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcaggcctacaagaggaagacagaagcagcaaagaaggaatatctgaaggccctggcagcctaccgggctagcctcgtctccaagagctccccagatcaaggtgagaccaagagcactcaggcaaacccaccagccaaaatgctcccacccaagcagcccatgtatgccatgccaggcctggcctccttcctgacgccgtcggacctgcaggccttccgcagtggggcctcccctgccagcctcgcccggacgctgggctccaagtctctgctgccaggcctcagtgcgtccccgccgccgccaccctccttcccgctcagccccacactgcaccagcagctgtcactgccccctcacgcccagggcgccctcctcagtccacctgttagcatgtccccagccccccagccccctgtcctgcccacccccatggcactccaggtgcagctggcgatgagcccctcacctccagggccacaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggccgcccctggcggggtcgcttaccaacggacacccaccccagatgcatgggccagagggccggcccccggcatagatgtgcacatcggttttccagtgtgaacaaaagattacgaaacctagaaactgttggttccgtgtaagtagttgactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaagttacagcttatcctaccgtgtgtgtggttttggggtttcgtttgggtttgggttcttgacgtcgtttgcagctgtttcctggccctggcgagtgtctgtcttggtgcccagtgcttctctcaaatctctttataataaaacttctgaaaagctgaaaaaaaaaaaaaaaaaa

SEQ ID NO: 280 - protein, 464 aa, Artificial Sequence
  TOX2
MSDGNPELLSTSQTYNGQSENNEDYEIPPITPPNLPEPSLLHLGDHEASYHSLCHGLTPNGLLPAYSYQAMDLPAIMVSNMLAQDSHLLSGQLPTIQEMVHSEVAAYDSGRPGPLLGRPAMLASHMSALSQSQLISQMGIRSSIAHSSPSPPGSKSATPSPSSSTQEEESEVHFKISGEKRPSADPGKKAKNPKKKKKKDPNEPQKPVSAYALFFRDTQAAIKGQNPSATFGDVSKIVASMWDSLGEEQKQAYKRKTEAAKKEYLKALAAYRASLVSKSSPDQGETKSTQANPPAKMLPPKQPMYAMPGLASFLTPSDLQAFRSGASPASLARTLGSKSLLPGLSASPPPPPSFPLSPTLHQQLSLPPHAQGALLSPPVSMSPAPQPPVLPTPMALQVQLAMSPSPPGPQDFPHISEFPSSSGSCSPGPSNPTSSGDWDSSYPSGECGISTCSLLPRDKSLYLT

SEQ ID NO: 281 - protein, 506 aa, Artificial Sequence
  TOX2
MDVRLYPSAPAVGARPGAEPAGLAHLDYYHGGKFDGDSAYVGMSDGNPELLSTSQTYNGQSENNEDYEIPPITPPNLPEPSLLHLGDHEASYHSLCHGLTPNGLLPAYSYQAMDLPAIMVSNMLAQDSHLLSGQLPTIQEMVHSEVAAYDSGRPGPLLGRPAMLASHMSALSQSQLISQMGIRSSIAHSSPSPPGSKSATPSPSSSTQEEESEVHFKISGEKRPSADPGKKAKNPKKKKKKDPNEPQKPVSAYALFFRDTQAAIKGQNPSATFGDVSKIVASMWDSLGEEQKQAYKRKTEAAKKEYLKALAAYRASLVSKSSPDQGETKSTQANPPAKMLPPKQPMYAMPGLASFLTPSDLQAFRSGASPASLARTLGSKSLLPGLSASPPPPPSFPLSPTLHQQLSLPPHAQGALLSPPVSMSPAPQPPVLPTPMALQVQLAMSPSPPGPQDFPHISEFPSSSGSCSPGPSNPTSSGDWDSSYPSGECGISTCSLLPRDKSLYLT

SEQ ID NO: 282 - protein, 488 aa, Artificial Sequence
  TOX2
MQQTRTEAVAGAFSRCLGFCGMRLGLLLLARHWCIAGVFPQKFDGDSAYVGMSDGNPELLSTSQTYNGQSENNEDYEIPPITPPNLPEPSLLHLGDHEASYHSLCHGLTPNGLLPAYSYQAMDLPAIMVSNMLAQDSHLLSGQLPTIQEMVHSEVAAYDSGRPGPLLGRPAMLASHMSALSQSQLISQMGIRSSIAHSSPSPPGSKSATPSPSSSTQEEESEVHFKISGEKRPSADPGKKAKNPKKKKKKDPNEPQKPVSAYALFFRDTQAAIKGQNPSATFGDVSKIVASMWDSLGEEQKQSSPDQGETKSTQANPPAKMLPPKQPMYAMPGLASFLTPSDLQAFRSGASPASLARTLGSKSLLPGLSASPPPPPSFPLSPTLHQQLSLPPHAQGALLSPPVSMSPAPQPPVLPTPMALQVQLAMSPSPPGPQDFPHISEFPSSSGSCSPGPSNPTSSGDWDSSYPSGECGISTCSLLPRDKSLYLT

SEQ ID NO: 283 - protein, 464 aa, Artificial Sequence; identical to SEQ ID NO: 280
  TOX2

SEQ ID NO: 284 - DNA, 2547 bp, Artificial Sequence
  HCP5
gactcagattctccccagacgccaaggttgcgggtcatggagtcccgaaccctcctcctgctgttctcgggagccgtggccctgatccagacctgggcagattacaattacaatcaaggcagaaatgatctcatttttacattacaactctggaaaaggcaatagactgagatgcaagtgtgcccccaagtgatgggcagaaggagagaaggtgttttggatgcattctagaacacaggtaatctaaggagagttgatcaaggccgtggaagagtcctccagccactattggccatcaaaggagtcctctgtgtcccaggaatggtcctgctttggtgtccctggtgtgacccatcacccgctgggaacagcctgagagaagtagggcctctgcaccaatgctgctgaggatgtcagagcacaggaacgaggccttgggaaattacctggaaatgcgactgaaatcttccttcctgaggggtctgggctcttggaaatcaaaccctctcaggttgggtggctggacgattctcctcacacttacaatgggacaaggggaaccaggaggcccccaaggggatccctgggttccacacgaactcctcctaccctcattgtgtgacagcagccatgcctcctcctggggatcaggatctattacctgtgcctggagaggaggggactcctcttctcacccgctggtctctggacacatactgtccaattcccctgtggcagctgtaatgtgtagttcaatgggcactcatttgtccccttttaagggtaccctcctttagaatccaggaccttctaccctgcagagtgtggttttgggagagaagtgcaaaatcccacgacaggtgagttgaaggaatgggatatggagccacatccacttccaccccttggtatctggacccacgtgttcttcctactgagattacagaactgtagagatgtctttgatttttaaaatgcaccatgtcctgaaagatggcaccctcccacccgcagagtgcttcctgcaagctggcgttgagctgtgcctatagaagctcttttcaacattctttatggccagcagcccttggttggtgcagatggtgataggaccagtgggtcccacagcatggccacactgcacctccttcgctgtcaagtgggtcccccacgaagatactgcacggagagcagtgccaagcctgtggatcaggaatatcaacagcccccagagagtggtgctggctgagggtctgagagcaggacaggaaaacccacctatggaataggtgcctatccctgtgaagatgaacctctggcccttccaggatggaaggagtgcaatgtagtcaactcctcacttagggtctggttggtcacctaaagaaatagagccctaccagggaagatcattgggttcaaatgctgatgagtaggacatttagaggtggcagtgtctggatctaccttggtaggagggagtcagtactgttggacccataggtagcctcatccctgccactgtgtttgctccatttatgtacccatcctacccggcctgggctgacccatggggaaggctggctaatttcagtgcttctgcttggttgttcagggccatttcaggtttgggtgttttctggggatgttaacatgggattcaggctcaactcacaagaaacttttccatctcatgatggatgctgttgggcatgtccaatgtatgacttcatgagttacacagatgctaattcgtaggggcacttggaatcacatggttgttttgtgtcccatggtcaagcattctatcttatcagggcctacagtaacatgccaaaagttgcttccaacatatttctctgctttggatggggcatatttctgtgctgtggatgacatggccttactccagaatcccaggccctccactgtgactctcctactggtgcttggttcagctccaccccaaatcttaccccaccactggcactttcagcaccagggggtctgaaggatggtgactgcgccatggcctggatctgctgcagtgtcctttcctgtggaggctccactcaaagctggcatcctcctatgtcacctagagtgtgggtcaaagcaatacacctacatgtagaatgtgatgtcagaactcaaacaggctcaccaggcagtgtgcttccttccttgcatgaggatgcaagatgcaacagtttgtctttcacattggaagggacacccctggatgcccctaaccactagacctgtaaaacttcactgcagtggccacttctgaatctctgtaaggtttatttatcttcaccctctggagagaagatgttttaccaaagcctctagtgtaccttcctcctcttactcatccatcccagtcaacatgatgttgtcaatgaaataaaggaatttaatattctatagtatatccaggttctccagatctcttaagactgtactatagaggcctggggaattataatagccctgaggcaaactatgaattaaagtgttgtggatcccacatgaaaaaaaaaa

SEQ ID NO: 285 - DNA, 1538 bp, Artificial Sequence
  RAC2
agcagcttgagtaagttccccttccgtttcctcctgccccaccaccgctgctcctcagcaggcgcctcaccagcctccacaccccttgcgcccgcagaaacgcgcctggccctgagctgtcaccaccgacactctccaggctccggacacgatgcaggccatcaagtgtgtggtggtgggagatggggccgtgggcaagacctgccttctcatcagctacaccaccaacgcctttcccggagagtacatccccaccgtgtttgacaactattcagccaatgtgatggtggacagcaagccagtgaacctggggctgtgggacactgctgggcaggaggactacgaccgtctccggccgctctcctatccacagacggacgtcttcctcatctgcttctccctcgtcagcccagcctcttatgagaacgtccgcgccaagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattgactcggtgaaatacctggagtgctcagctctcacccagagaggcctgaaaaccgtgttcgacgaggccatccgggccgtgctgtgccctcagcccacgcggcagcagaagcgcgcctgcagcctcctctaggggttgcaccccagcgctcccacctagatgggtctgatcctccaggatccccacccaaagcctgatggcaccccggctggccatgctgtcccctccctgtggcgtttcttagcagatggctgcagagcttcgttgatggtcttttctgtactggaggcctcctgaggccaggaacgtgcaaatttgcaggtgctgcatcccaagcccctcatgctcctgccttcctgagggccagaggggagccccaggacccattaagccacccccgtgttcctgccgtcagtgccaactgccgcatgtggaagcatctacccgttcactccagtcccaccccacgcctgactcccctctggaaactgcaggccagatggttgctgccacaacttgtgtaccttcagggatggggctcttactccctcctgaggccagctgctctaatatcgatggtcctgcttgccagagagttcctctacccagcaaaaatgagtgtctcagaagtgtgctcctctggcctcagttctcctcttttggaacaacataaaacaaatttaattttctacgcctctggggatatctgctcagccaatggaaaatctgggttcaaccagcccctgccatttcttaagactttctgctgcactcacaggatcctgagctgcacttacctgtgagagtcttcaaacttttaaaccttgccagtcaggacttttgctattgcaaatagaaaacccaactcaacctgcttaagcagaaaataaatttattgattcaagtttggagaaaaaaaaaaaaaaaaaaaaaaaaaaaa

SEQ ID NO: 286 - protein, 192 aa, Artificial Sequence
  RAC2
MQAIKCVVVGDGAVGKTCLLISYTTNAFPGEYIPTVFDNYSANVMVDSKPVNLGLWDTAGQEDYDRLRPLSYPQTDVFLICFSLVSPASYENVRAKWFPEVRHHCPSTPIILVGTKLDLRDDKDTIEKLKEKKLAPITYPQGLALAKEIDSVKYLECSALTQRGLKTVFDEAIRAVLCPQPTRQQKRACSLL

SEQ ID NO: 287 - DNA, 1403 bp, Artificial Sequence
  RGS1
gcctgtctgcattctactatataaagcagcagagacgttgactagcgcatatttgctaagagcaccatgcgcgcagcagccatctccactccaaagttagacaaaatgccaggaatgttcttctctgctaacccaaaggaattgaaaggaaccactcattcacttctagacgacaaaatgcaaaaaaggaggccaaagacttttggaatggatatgaaagcatacctgagatctatgatcccacatctggaatctggaatgaaatcttccaagtccaaggatgtactttctgctgctgaagtaatgcaatggtctcaatctctggaaaaacttcttgccaaccaaactggtcaaaatgtctttggaagtttcctaaagtctgaattcagtgaggagaatattgagttctggctggcttgtgaagactataagaaaacagagtctgatcttttgccctgtaaagcagaagagatatataaagcatttgtgcattcagatgctgctaaacaaatcaatattgacttccgcactcgagaatctacagccaagaagattaaagcaccaacccccacgtgttttgatgaagcacaaaaagtcatatatactcttatggaaaaggactcttatcccaggttcctcaaatcagatatttacttaaatcttctaaatgacctgcaggctaatagcctaaagtgactggtccctggctgaagggaattaacagatagtatcaagcgcagaaggaatgtgccagtatggctccctgggtgaacagcttggccttttttgggtgtcttgacaggccaagaagaacaaatgactcagaatggattaacatgaaagttatccaggcgcagagttgaagaagcataagcaagacaaaaacagagagaccgcagaaggaggaagatactgtggtactgtcataaaaaacagtggagctctgtattagaaagcccctcagaactgggaaggccaggtaactctagttacacagaaactgtgactaaagtctatgaaactgattacaacagactgtaagaatcaaagtcaactgacatctatgctacatattattatatagtttgtactgagctattgaagtcccattaacttaaagtatatgttttcaaattgccattgctactattgcttgtcggtgttattttattttattgtttttgactttggaagagatgaactgtgtatttaacttaagctattgctcttaaaaccagggagtcagaatatatttgtaagttaaatcattggtgctaataataaatgtggattttgtattaaaatatatagaagcaatttctgtttacatgtccttgctacttttaaaaacttgcatttattcctcagattttaaaaataaataaataattcatttaagattc

SEQ ID NO: 288 - protein, 209 aa, Artificial Sequence
  RGS1
MRAAAISTPKLDKMPGMFFSANPKELKGTTHSLLDDKMQKRRPKTFGMDMKAYLRSMIPHLESGMKSSKSKDVLSAAEVMQWSQSLEKLLANQTGQNVFGSFLKSEFSEENIEFWLACEDYKKTESDLLPCKAEEIYKAFVHSDAAKQINIDFRTRESTAKKIKAPTPTCFDEAQKVIYTLMEKDSYPRFLKSDIYLNLLNDLQANSLK

SEQ ID NO: 289 - DNA, 2789 bp, Artificial Sequence
  STAT4
aggggcaaggctactcaaggagagtaggaggaggctaggtcaggaagggcaagcactggtggcctacccaggacttggcccaaccctctgggtcaggtcaccctcgtcggagtgagcggaccccgctggaattggagcccagtaaggtctatgagtttggtgttttgatcctggctacccatcccttccatcccaggggtggttcaccaggctgagtggagccttatactagggagagaggaagctgaagaactgggctccagcatgtctcagtggaatcaagtccaacagttagaaatcaagtttttggagcaggtggatcaattctatgatgacaactttcccatggaaattcggcatctgttggcccaatggattgaaaatcaagactgggaggcagcttctaacaatgaaaccatggcaacgattcttcttcaaaacttgttaatacaactggatgaacagttaggtcgtgtttccaaagagaaaaacctactcttgatacacaatctaaaaagaattaggaaggtccttcagggaaaatttcatggaaatccaatgcatgtagctgtggttatttcaaactgtttaagggaagagaggagaatattggctgcagccaacatgcctgtccaggggcctctagagaaatccttacaaagttcttcagtttcagaaagacagaggaatgtggagcacaaagtggctgccattaaaaacagtgtgcagatgacagaacaagataccaaatacttagaagatctgcaagacgaatttgactacaggtataaaacaattcagacaatggatcagagtgacaagaatagtgccatggtgaatcaggaagttttgacactgcaggaaatgcttaacagcctcgatttcaagagaaaggaggctctcagtaaaatgacccaaatcatccatgagacagacctgttaatgaacaccatgctcatagaagagctgcaagactggaagcggcggcagcaaatcgcctgcatcgggggtccactccacaatgggctcgaccagcttcagaactgctttacactattggcagaaagtcttttccaactgagaaggcaattggagaaactagaggagcaatctaccaaaatgacatatgaaggtgatcccattccaatgcaaagaactcacatgctagaaagagtcaccttcttgatctacaaccttttcaagaactcatttgtggttgagcgacagccatgtatgccaacccaccctcagaggccgttggtacttaaaaccctaattcagttcactgtaaaactaaggctactaataaaattgccagaactaaactatcaggtaaaggttaaggcatcaattgacaagaatgtttcaactctaagcaaccgaagatttgtactttgtggaactaatgtcaaagccatgtctattgaagaatcttccaatgggagtctctcagtagaatttcgacatttgcaaccaaaggaaatgaagtccagtgctggaggtaaaggaaatgagggctgtcacatggtgactgaagaacttcattccataacgtttgaaacacagatctgcctctatggcctgaccatagatttggagaccagctcattgcctgtggtgatgatttccaatgtcagtcagttacctaatgcttgggcatccatcatttggtacaacgtgtcaaccaacgattcccagaacttggttttctttaataatcctccacctgccacattgagtcaactactggaggtgatgagctggcagttttcatcgtacgttggtcgtggtcttaactcagatcaactccatatgctggcagagaagcttacagtccaatctagctacagtgatggtcacctcacctgggccaagttctgcaaggaacatttacctggtaaatcatttaccttttggacatggcttgaagcaatattggatctaattaagaaacacattcttcccctttggattgatgggtatgtcatgggctttgttagcaaagagaaggaacggctgttgctaaaggataaaatgcctggcacctttttattaagattcagtgaaagccatctcggaggaataactttcacctgggtggaccattctgaaagtggggaagtgagattccactctgtagaaccctacaataaaggccggttgtctgctctgccattcgctgacatcctgcgagactacaaagttattatggctgaaaacattcctgaaaaccctctgaagtacctatatcctgacattcccaaagacaaagccttcggtaaacactacagctctcagccttgcgaagtttcaagaccaacagaaaggggtgacaaaggttatgttccttctgtttttatccccatctcaacaatccgaagtgattcaacagagccacattctccatcagaccttcttcccatgtctccaagtgtgtatgcggtgttgagagaaaacctgagtcccacaacaattgaaactgcaatgaagtctccttattctgctgaatgacaggataaactctgacgcaccaagaaaggaagcaaatgaaaaagtttaaagactgttctttgcccaataaccacattttatttcttcagctttgtaaataccaggttctaggaaatgtttgacatctgaagctctcttcacactcccgtggcactcctcaattgggagtgttgtgactgaaatgcttgaaaccaaagcttcagataaacttgcaagataagacaactttaagaaaccagtgttaataacaatattaacagaagaaaaaaaaaaaaaaa

SEQ ID NO: 290 - DNA, 2840 bp, Artificial Sequence
  STAT4
tttttcctggcactgctgagccacctgcagttgcgagagccgctgggagggataagagggaagaggacgcccggtgaaggggctccagcctggcagtttctgcgtgttagcatttctagaatagagtgggtgggaactgacccaagtaaagtcccagagactcgaacactgacgcacaggaaagcctcaagtgggaggagaaatgcaaatcccctactgatgatggcgtcagcggctttctcctagggactgtgaggggcgcttctgactttggacttgagcactgcctgggacctgtgctgagagagcgctagcatgtctcagtggaatcaagtccaacagttagaaatcaagtttttggagcaggtggatcaattctatgatgacaactttcccatggaaattcggcatctgttggcccaatggattgaaaatcaagactgggaggcagcttctaacaatgaaaccatggcaacgattcttcttcaaaacttgttaatacaactggatgaacagttaggtcgtgtttccaaagagaaaaacctactcttgatacacaatctaaaaagaattaggaaggtccttcagggaaaatttcatggaaatccaatgcatgtagctgtggttatttcaaactgtttaagggaagagaggagaatattggctgcagccaacatgcctgtccaggggcctctagagaaatccttacaaagttcttcagtttcagaaagacagaggaatgtggagcacaaagtggctgccattaaaaacagtgtgcagatgacagaacaagataccaaatacttagaagatctgcaagacgaatttgactacaggtataaaacaattcagacaatggatcagagtgacaagaatagtgccatggtgaatcaggaagttttgacactgcaggaaatgcttaacagcctcgatttcaagagaaaggaggctctcagtaaaatgacccaaatcatccatgagacagacctgttaatgaacaccatgctcatagaagagctgcaagactggaagcggcggcagcaaatcgcctgcatcgggggtccactccacaatgggctcgaccagcttcagaactgctttacactattggcagaaagtcttttccaactgagaaggcaattggagaaactagaggagcaatctaccaaaatgacatatgaaggtgatcccattccaatgcaaagaactcacatgctagaaagagtcaccttcttgatctacaaccttttcaagaactcatttgtggttgagcgacagccatgtatgccaacccaccctcagaggccgttggtacttaaaaccctaattcagttcactgtaaaactaaggctactaataaaattgccagaactaaactatcaggtaaaggttaaggcatcaattgacaagaatgtttcaactctaagcaaccgaagatttgtactttgtggaactaatgtcaaagccatgtctattgaagaatcttccaatgggagtctctcagtagaatttcgacatttgcaaccaaaggaaatgaagtccagtgctggaggtaaaggaaatgagggctgtcacatggtgactgaagaacttcattccataacgtttgaaacacagatctgcctctatggcctgaccatagatttggagaccagctcattgcctgtggtgatgatttccaatgtcagtcagttacctaatgcttgggcatccatcatttggtacaacgtgtcaaccaacgattcccagaacttggttttctttaataatcctccacctgccacattgagtcaactactggaggtgatgagctggcagttttcatcgtacgttggtcgtggtcttaactcagatcaactccatatgctggcagagaagcttacagtccaatctagctacagtgatggtcacctcacctgggccaagttctgcaaggaacatttacctggtaaatcatttaccttttggacatggcttgaagcaatattggatctaattaagaaacacattcttcccctttggattgatgggtatgtcatgggctttgttagcaaagagaaggaacggctgttgctaaaggataaaatgcctggcacctttttattaagattcagtgaaagccatctcggaggaataactttcacctgggtggaccattctgaaagtggggaagtgagattccactctgtagaaccctacaataaaggccggttgtctgctctgccattcgctgacatcctgcgagactacaaagttattatggctgaaaacattcctgaaaaccctctgaagtacctatatcctgacattcccaaagacaaagccttcggtaaacactacagctctcagccttgcgaagtttcaagaccaacagaaaggggtgacaaaggttatgttccttctgtttttatccccatctcaacaatccgaagtgattcaacagagccacattctccatcagaccttcttcccatgtctccaagtgtgtatgcggtgttgagagaaaacctgagtcccacaacaattgaaactgcaatgaagtctccttattctgctgaatgacaggataaactctgacgcaccaagaaaggaagcaaatgaaaaagtttaaagactgttctttgcccaataaccacattttatttcttcagctttgtaaataccaggttctaggaaatgtttgacatctgaagctctcttcacactcccgtggcactcctcaattgggagtgttgtgactgaaatgcttgaaaccaaagcttcagataaacttgcaagataagacaactttaagaaaccagtgttaataacaatattaacagaagaaaaaaaaaaaaaaa

SEQ ID NO: 291 - protein, 748 aa, Artificial Sequence
  STAT4
MSQWNQVQQLEIKFLEQVDQFYDDNFPMEIRHLLAQWIENQDWEAASNNETMATILLQNLLIQLDEQLGRVSKEKNLLLIHNLKRIRKVLQGKFHGNPMHVAVVISNCLREERRILAAANMPVQGPLEKSLQSSSVSERQRNVEHKVAAIKNSVQMTEQDTKYLEDLQDEFDYRYKTIQTMDQSDKNSAMVNQEVLTLQEMLNSLDFKRKEALSKMTQIIHETDLLMNTMLIEELQDWKRRQQIACIGGPLHNGLDQLQNCFTLLAESLFQLRRQLEKLEEQSTKMTYEGDPIPMQRTHMLERVTFLIYNLFKNSFVVERQPCMPTHPQRPLVLKTLIQFTVKLRLLIKLPELNYQVKVKASIDKNVSTLSNRRFVLCGTNVKAMSIEESSNGSLSVEFRHLQPKEMKSSAGGKGNEGCHMVTEELHSITFETQICLYGLTIDLETSSLPVVMISNVSQLPNAWASIIWYNVSTNDSQNLVFFNNPPPATLSQLLEVMSWQFSSYVGRGLNSDQLHMLAEKLTVQSSYSDGHLTWAKFCKEHLPGKSFTFWTWLEAILDLIKKHILPLWIDGYVMGFVSKEKERLLLKDKMPGTFLLRFSESHLGGITFTWVDHSESGEVRFHSVEPYNKGRLSALPFADILRDYKVIMAENIPENPLKYLYPDIPKDKAFGKHYSSQPCEVSRPTERGDKGYVPSVFIPISTIRSDSTEPHSPSDLLPMSPSVYAVLRENLSPTTIETAMKSPYSAE

SEQ ID NO: 292 - protein, 748 aa, Artificial Sequence; identical to SEQ ID NO: 291
  STAT4

SEQ ID NO: 293 - DNA, 1412 bp, Artificial Sequence
  HLA-DMB
atttgtccctgcctacctagccaatctgtccctgtttgggacactggactcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacactggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagttacactcctcttcctgggtccaattattcagaaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgttaaaaaaaaaaaaaaa

SEQ ID NO: 294 - protein, 263 aa, Artificial Sequence
  HLA-DMB
MITFLPLLLGLSLGCTGAGGFVAHVESTCLLDDAGTPKDFTYCISFNKDLLTCWDPEENKMAPCEFGVLNSLANVLSQHLNQKDTLMQRLRNGLQNCATHTQPFWGSLTNRTRPPSVQVAKTTPFNTREPVMLACYVWGFYPAEVTITWRKNGKLVMPHSSAHKTAQPNGDWTYQTLSHLALTPSYGDTYTCVVEHTGAPEPILRDWTPGLSPMQTLKVSVSAVTLGLGLIIFSLGVISWRRAGHSSYTPLPGSNYSEGWHIS

SEQ ID NO: 295 - DNA, 3936 bp, Artificial Sequence
  NT5E
actcctcctctctgcccctcagctcgctcatctttcttcccgccccctctcttttccttctttggttctttgaagtgatgagctagcgcaaccacaaaccatacattccttttgtagaaaaacccgtgcctcgaatgaggcgagactcagagaggacccaggcgcggggcggacccctccaattccttcctcgcgcccccgaaagagcggcgcaccagcagccgaactgccggcgcccaggctccctggtccggccgggatgcggccggtacccgctccccgccgggaacaacctctccactcttcctgcagggagctggtgccagccgacagccgcgccagggccgctccgggtaccagggtcggatcgggtgacgtcgcgaacttgcgcctggccgccaagccggcctccaggctgaagaaggacccgccccggccttgacccgggccccgcccctccagccggggcaccgagccccggccctagctgctcgcccctactcgccggcactcgcccggctcgcccgctttcgcacccagttcacgcgccacagctatgtgtccccgagccgcgcgggcgcccgcgacgctactcctcgccctgggcgcggtgctgtggcctgcggctggcgcctgggagcttacgattttgcacaccaacgacgtgcacagccggctggagcagaccagcgaggactccagcaagtgcgtcaacgccagccgctgcatgggtggcgtggctcggctcttcaccaaggttcagcagatccgccgcgccgaacccaacgtgctgctgctggacgccggcgaccagtaccagggcactatctggttcaccgtgtacaagggcgccgaggtggcgcacttcatgaacgccctgcgctacgatgccatggcactgggaaatcatgaatttgataatggtgtggaaggactgatcgagccactcctcaaagaggccaaatttccaattctgagtgcaaacattaaagcaaaggggccactagcatctcaaatatcaggactttatttgccatataaagttcttcctgttggtgatgaagttgtgggaatcgttggatacacttccaaagaaaccccttttctctcaaatccagggacaaatttagtgtttgaagatgaaatcactgcattacaacctgaagtagataagttaaaaactctaaatgtgaacaaaattattgcactgggacattcgggttttgaaatggataaactcatcgctcagaaagtgaggggtgtggacgtcgtggtgggaggacactccaacacatttctttacacaggcaatccaccttccaaagaggtgcctgctgggaagtacccattcatagtcacttctgatgatgggcggaaggttcctgtagtccaggcctatgcttttggcaaatacctaggctatctgaagatcgagtttgatgaaagaggaaacgtcatctcttcccatggaaatcccattcttctaaacagcagcattcctgaagatccaagcataaaagcagacattaacaaatggaggataaaattggataattattctacccaggaattagggaaaacaattgtctatctggatggctcctctcaatcatgccgctttagagaatgcaacatgggcaacctgatttgtgatgcaatgattaacaacaacctgagacacacggatgaaatgttctggaaccacgtatccatgtgcattttaaatggaggtggtatccggtcgcccattgatgaacgcaacaatggaatccatgtggtgtatgatctttcccgaaaacctggagacagagtagtcaaattagatgttctttgcaccaagtgtcgagtgcccagttatgaccctctcaaaatggacgaggtatataaggtgatcctcccaaacttcctggccaatggtggagatgggttccagatgataaaagatgaattattaagacatgactctggtgaccaagatatcaacgtggtttctacatatatctccaaaatgaaagtaatttatccagcagttgaaggtcggatcaagttttccacaggaagtcactgccatggaagcttttctttaatatttctttcactttgggcagtgatctttgttttataccaatagccaaaaattctccttgcctttaatgtgtgaaactgcattttttcaagtgagattcaaatctgccttttaggacctggctttgtgacagcaaaaaccatctttacaggctcctagaagctgaaggttagagcattataaaatgaagagacagacatgattactcagggtcagcaacctagtgagttagaaaaaaaattaacatagggccctataaggagaaagccaactatgttaagtttacgtgtccaaattttaatgaaattttactaacaattttaaaccatatttttcttcttcatatccatttctaatccatcaaacagcttatgtttacataaaattttatcattcacaaggaagttttaagcacactgtctcatttgatatccacaacttatttttggtaggaaagagagatgtttttcccacctgtcagatgaaaaaactgaagctcaaaaagggttgacttgaccatacagctaatgctgacagatccaagacctagacctaggtcttttgaactcaagtccagcattctcaactatatcaagttactgttcagaatacttaatatctcctctcttcataattatcaatagccccaagctcatggatgacaaatctctgctttatttcttgtctctattttttcactttatagctcctgttataatagcaagtttaatggtataaacacaggataccatcctctcttgcaacacccatgtgcctttgatgagtcaggtagcaagctgtagtagataatgagaaaggccagaggctgcaaaagacagtcaaaggacacgagagaaaggaaggggaagaacaggactccaggactgttttatattatagaaaagcaagagctaaagagcatttacacatgttaaacagatacttgttaagcatagtgcctgacacacggcattagctgttattttatgagattccatcagctctgcctctgtcctctttcttctaacatgaaggtatcatgagaagagaaccttctaacataagctgtaattctaaacctgcacttgtccctctccagcaagaggctagcactgaattcattctactcatactacacacccagttatggaatgtccagagttctcgaagaaaataaatgactttaggaagaggtatacattttttaagtcgctctgcctccaaatctgaacagtcactgtaaatcattcttaagcccagatatgagaacttctgctggaaagtgggaccctctgagtgggtggtcagaaaatacccatgctgatgaaatgacctatgcccaaagaacaaatacttaacgtgggagtggaaccacatgagcctgctcagctctgcataagtaattcaagaaatgggaggcttcaccttaaaaacagtgtgcaaatggcagctagaggttttgataggaagtatgtttgtttcttagtgtttacaaatattaagtactcttgatacaaaatatacttttaaacttcataacctttttataaaagttgttgcagcaaaataatagcctcggttctatgcatatatggattagctataaaaaatgtcaataagattgtacaaggaaaattagagaaagtcacatttagggtttattttttacacttggccagtaaaatagggtaaatcctattagaattttttaaagaactttttttaagtttcctaaatctgtgtgtgtattgtgaagtggtataagaaatgactttgaaccactttgcaattgtagattcccaacaataaaattgaagataagctctttggtcaaaaaaaaaaaaaaaaaa

SEQ ID NO: 296 - DNA, 4086 bp, Artificial Sequence
  NT5E
actcctcctctctgcccctcagctcgctcatctttcttcccgccccctctcttttccttctttggttctttgaagtgatgagctagcgcaaccacaaaccatacattccttttgtagaaaaacccgtgcctcgaatgaggcgagactcagagaggacccaggcgcggggcggacccctccaattccttcctcgcgcccccgaaagagcggcgcaccagcagccgaactgccggcgcccaggctccctggtccggccgggatgcggccggtacccgctccccgccgggaacaacctctccactcttcctgcagggagctggtgccagccgacagccgcgccagggccgctccgggtaccagggtcggatcgggtgacgtcgcgaacttgcgcctggccgccaagccggcctccaggctgaagaaggacccgccccggccttgacccgggccccgcccctccagccggggcaccgagccccggccctagctgctcgcccctactcgccggcactcgcccggctcgcccgctttcgcacccagttcacgcgccacagctatgtgtccccgagccgcgcgggcgcccgcgacgctactcctcgccctgggcgcggtgctgtggcctgcggctggcgcctgggagcttacgattttgcacaccaacgacgtgcacagccggctggagcagaccagcgaggactccagcaagtgcgtcaacgccagccgctgcatgggtggcgtggctcggctcttcaccaaggttcagcagatccgccgcgccgaacccaacgtgctgctgctggacgccggcgaccagtaccagggcactatctggttcaccgtgtacaagggcgccgaggtggcgcacttcatgaacgccctgcgctacgatgccatggcactgggaaatcatgaatttgataatggtgtggaaggactgatcgagccactcctcaaagaggccaaatttccaattctgagtgcaaacattaaagcaaaggggccactagcatctcaaatatcaggactttatttgccatataaagttcttcctgttggtgatgaagttgtgggaatcgttggatacacttccaaagaaaccccttttctctcaaatccagggacaaatttagtgtttgaagatgaaatcactgcattacaacctgaagtagataagttaaaaactctaaatgtgaacaaaattattgcactgggacattcgggttttgaaatggataaactcatcgctcagaaagtgaggggtgtggacgtcgtggtgggaggacactccaacacatttctttacacaggcaatccaccttccaaagaggtgcctgctgggaagtacccattcatagtcacttctgatgatgggcggaaggttcctgtagtccaggcctatgcttttggcaaatacctaggctatctgaagatcgagtttgatgaaagaggaaacgtcatctcttcccatggaaatcccattcttctaaacagcagcattcctgaagatccaagcataaaagcagacattaacaaatggaggataaaattggataattattctacccaggaattagggaaaacaattgtctatctggatggctcctctcaatcatgccgctttagagaatgcaacatgggcaacctgatttgtgatgcaatgattaacaacaacctgagacacacggatgaaatgttctggaaccacgtatccatgtgcattttaaatggaggtggtatccggtcgcccattgatgaacgcaacaatggcacaattacctgggagaacctggctgctgtattgccctttggaggcacatttgacctagtccagttaaaaggttccaccctgaagaaggcctttgagcatagcgtgcaccgctacggccagtccactggagagttcctgcaggtgggcggaatccatgtggtgtatgatctttcccgaaaacctggagacagagtagtcaaattagatgttctttgcaccaagtgtcgagtgcccagttatgaccctctcaaaatggacgaggtatataaggtgatcctcccaaacttcctggccaatggtggagatgggttccagatgataaaagatgaattattaagacatgactctggtgaccaagatatcaacgtggtttctacatatatctccaaaatgaaagtaatttatccagcagttgaaggtcggatcaagttttccacaggaagtcactgccatggaagcttttctttaatatttctttcactttgggcagtgatctttgttttataccaatagccaaaaattctccttgcctttaatgtgtgaaactgcattttttcaagtgagattcaaatctgccttttaggacctggctttgtgacagcaaaaaccatctttacaggctcctagaagctgaaggttagagcattataaaatgaagagacagacatgattactcagggtcagcaacctagtgagttagaaaaaaaattaacatagggccctataaggagaaagccaactatgttaagtttacgtgtccaaattttaatgaaattttactaacaattttaaaccatatttttcttcttcatatccatttctaatccatcaaacagcttatgtttacataaaattttatcattcacaaggaagttttaagcacactgtctcatttgatatccacaacttatttttggtaggaaagagagatgtttttcccacctgtcagatgaaaaaactgaagctcaaaaagggttgacttgaccatacagctaatgctgacagatccaagacctagacctaggtcttttgaactcaagtccagcattctcaactatatcaagttactgttcagaatacttaatatctcctctcttcataattatcaatagccccaagctcatggatgacaaatctctgctttatttcttgtctctattttttcactttatagctcctgttataatagcaagtttaatggtataaacacaggataccatcctctcttgcaacacccatgtgcctttgatgagtcaggtagcaagctgtagtagataatgagaaaggccagaggctgcaaaagacagtcaaaggacacgagagaaaggaaggggaagaacaggactccaggactgttttatattatagaaaagcaagagctaaagagcatttacacatgttaaacagatacttgttaagcatagtgcctgacacacggcattagctgttattttatgagattccatcagctctgcctctgtcctctttcttctaacatgaaggtatcatgagaagagaaccttctaacataagctgtaattctaaacctgcacttgtccctctccagcaagaggctagcactgaattcattctactcatactacacacccagttatggaatgtccagagttctcgaagaaaataaatgactttaggaagaggtatacattttttaagtcgctctgcctccaaatctgaacagtcactgtaaatcattcttaagcccagatatgagaacttctgctggaaagtgggaccctctgagtgggtggtcagaaaatacccatgctgatgaaatgacctatgcccaaagaacaaatacttaacgtgggagtggaaccacatgagcctgctcagctctgcataagtaattcaagaaatgggaggcttcaccttaaaaacagtgtgcaaatggcagctagaggttttgataggaagtatgtttgtttcttagtgtttacaaatattaagtactcttgatacaaaatatacttttaaacttcataacctttttataaaagttgttgcagcaaaataatagcctcggttctatgcatatatggattagctataaaaaatgtcaataagattgtacaaggaaaattagagaaagtcacatttagggtttattttttacacttggccagtaaaatagggtaaatcctattagaattttttaaagaactttttttaagtttcctaaatctgtgtgtgtattgtgaagtggtataagaaatgactttgaaccactttgcaattgtagattcccaacaataaaattgaagataagctctttggtcaaaaaaaaaaaaaaaaaa

SEQ ID NO: 297 - protein, 524 aa, Artificial Sequence
  NT5E
MCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGIHVVYDLSRKPGDRVVKLDVLCTKCRVPSYDPLKMDEVYKVILPNFLANGGDGFQMIKDELLRHDSGDQDINVVSTYISKMKVIYPAVEGRIKFSTGSHCHGSFSLIFLSLWAVIFVLYQ

SEQ ID NO: 298 - protein, 574 aa, Artificial Sequence
  NT5E
MCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGTITWENLAAVLPFGGTFDLVQLKGSTLKKAFEHSVHRYGQSTGEFLQVGGIHVVYDLSRKPGDRVVKLDVLCTKCRVPSYDPLKMDEVYKVILPNFLANGGDGFQMIKDELLRHDSGDQDINVVSTYISKMKVIYPAVEGRIKFSTGSHCHGSFSLIFLSLWAVIFVLYQ

SEQ ID NO: 299 - DNA, 4704 bp, Artificial Sequence
  BTG1
acttccttttcgtggcactataaagggtgctgcacggcgcttgcatctcttcgcctctcggagctggaaatgcagctattgagatcttcgaatgctgcggagctggaggcggaggcagctggggaggtccgagcgatgtgaccaggccgccatcgctcgtctcttcctctctcctgccgcctcctgtctcgaaaataacttttttagtctaaagaaagaaagacaaaagtagtcgtccgcccctcacgccctctcttcctctcagccttccgcccggtgaggaagcccggggtggctgctccgccgtcggggccgcgccgccgagccccagccgccccgggccgcccccgcacgccgcccccatgcatcccttctacacccgggccgccaccatgataggcgagatcgccgccgccgtgtccttcatctccaagtttctccgcaccaaggggctcacgagcgagcgacagctgcagaccttcagccagagcctgcaggagctgctggcagaacattataaacatcactggttcccagaaaagccatgcaagggatcgggttaccgttgtattcgcatcaaccataaaatggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcccttccaaaaactacaatatgatgactgtatcaggttaagatatagtctgtggatggatcatctgatgatgatggataaatttgatttttgctttgggtgggctcctcttggggatggattatggaatttaaaccatgtcacagctgtgaagatctggcacaagatagaatggtaaaaaaaaaaaaaattttaagtgacagtgccatagtttggacagtacctttcaatgattaattttaatagcctgtgagtccaagtaaatgatcactttatttgctagggagggaagtcctagggtggtttcagtttctcccagacatacctaaatttttacatcaatccttttaaagaaaatctgtatttcaaagaatctttctctgcagtaaatctcgcaggggaatttgcactattacacttgaaagttgttattgttaaccttttcggcagcttttaataggaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagtaaacttcttatttttagaaagtggaggtctggtttgtaactttccttgtacttaattgggtaaaagtcttttccacaaaccaccatctattttgtgaactttgttagtcatcttttatttggtaaattatgaactggtgtaaatttgtacagttcatgtatattgattgtggcaaagttgtacagatttctatattttggatgagaaatttttcttctctctataataaatcgtttcttatcttggcattttaatcaatctcttgtcatgattatagaggtttagctaaaagtattttttcttagaagacaggttctataaactgaatctctgttgcacactggtcatgctggaaaaacatttgatgaggaatgaagatgctctgtatatacatgtttaggttttacaggaaacacaggagtagcatgttttaaaaatttctaaagtcaaaacatggacacattcacaggctaatgatctcatgaaataaggataagagaccacggtagcatctaccaaaaatgtgatactcaaaggattacatttcattgcttccctgttgaagtgaagatataaatgttccattctgacccacctttgaaaaacaattactttgccccatggattctttgttcaattagaaatttccccggggcaggtgacccatagtcttaaagaacaggctaaacaccacagagagattggttgctttttgcttttcatcacctgcaagatgtacataaaaatcacataagctggaattcaacaaaaggtatgtttatgaacttttattctcaaaagttgaaatgctgactttctcgattcctcattttcagacttttatttcagataaatactaaaaacctaagtgaaccttgataatgctgtagtgtagattacttcactaccccatataatagaaggacttgctgtttagttgtagaggataacagcgtttttcagtggaaattgaaagtggaaaaattgaattttgctctacacagttaacatatagtggcctttttttggtatatatgtaaacatgttgacactggaaatacgcagtctgaaataaaattagtaattacttgaaattagtaatctcaaataacttttaagaagttatttctacacccaggaataaattattctgattttgtagacaacacaggaataggccactgaatatgcaggtatttagagtacaaatgtctgtggatattattggcacaccattctcgagagttagaattcgtagacccgcaacacatggactacccttgccaattgttatggttttatttttaaacctattctgtgaaaaagctcctcggtatttcaaacttgaattacaataaaaacaccaggtagggttgtttttaaatgggtctcaccccagtgctgactactgttgtttaccaactacatttcatctggtaactccattgaaactaagtacctcaaccattttttttttttatcataaagccttttttcaaatggaaagttgtttttgaagatcttgacatcagactttttcaatctttgaaaatgatggaaacagttaataaaaatgtttattttagaattcaggtgatgtctggcttgtgaggagctgtttataagtttgtctttgaaaaaggcttgcacacatcactctgagaccagctgtttcctgtgactttaaccttaccttccccagacaattgagctgaacctgtatctgcggtacagtagctgtttgtgatgtatttcttgttcactgtttctggggaatgttttgaaatattttattataaatccttttaagataggatgactactttcaaaattattgttgcctttggcaccaggaattcatagttgtgattggcagtaagtttgaggagtgttactttctaagttttaacaggtagttttgaaattatttccttttttccaaatttaagtagtgcctccctctgtaatgttgaaacaaggcttcaagtggattgtatagcaagagttaccctggttcatgcaggataatgcggctgttatctttgtcatctggaatgggaatctcatgtctttatccttatgtgcaatatttctataataatagactggaaaggccaccagaaagtggctttcaggtacattgcacaaatagtttccttaagtcattataactcacacattgcaagtaattaattttgttttgtataggtgttgcagtttatgaaattggccttcaagttaaaaggaaggaagccgtattcccgatggctagtgtttaatgactacaggtttccaggctccctttaatcttgggagcaaataaatctactattggacttctccctgcgtgacttttaacatttctgatactctctcttcttcctctttacagaagagaggtatgataactgaagttgtactttgcatattgaagtttaaagatacttcctctccccttttcacccctatttcaaatgatgtgataaaatcctcttgataggctatatggagaacatttgtcaatagttttatctatgcatggaagtcttcaaaaagtatatcttggattgtctaaaactgaatagatttcttatttatctgaaggtatacagactgccaacattttagacttatctctcagtctctgccactgaacttttatatatggctgctatcaaaatataaccggtttattttcatatttggaactaatataacagtatcacaaaatcttttacagtaagatagtttgtaataccagccgacccagctgcttaactgagtccttaaatcatttaatatatgggactgtaaatagagaaatctgtacattatgagatctgatttctggttatgcctatagatctttattttctttatccctatagatcattttcttctgatgttaagtgttatatttttgaaatgctcctaaacaagtaagccttagattgtattaatcctgaggattgataccatttcctcaacactttgtggagtatgattgacaccagtttttttttgactgcaggtttaacttggcttatcacttttcgtattgctcagtatgtccaagataggaataaaaaaatgtagttcaaaaaaaaaaaaaaaaaaaaaaaaaa

SEQ ID NO: 300 - protein, 171 aa, Artificial Sequence
  BTG1
MHPFYTRAATMIGEIAAAVSFISKFLRTKGLTSERQLQTFSQSLQELLAEHYKHHWFPEKPCKGSGYRCIRINHKMDPLIGQAAQRIGLSSQELFRLLPSELTLWVDPYEVSYRIGEDGSICVLYEASPAGGSTQNSTNVQMVDSRISCKEELLLGRTSPSKNYNMMTVSG

SEQ ID NO: 301 - DNA, 1648 bp, Artificial Sequence
  CD14
cagagaaggcttaggctcccgagtcaacagggcattcaccgcctggggcgcctgagtcatcaggacactgccaggagacacagaaccctagatgccctgcagaatccttcctgttacggtccccctccctgaaacatccttcattgcaatatttccaggaaaggaagggggctggctcggaggaagagaggtggggaggtgatcagggttcacagaggagggaactgaatgacatcccaggattacataaactgtcagaggcagccgaagagttcacaagtgtgaagcctggaagccggcgggtgccgctgtgtaggaaagaagctaaagcacttccagagcctgtccggagctcagaggttcggaagacttatcgaccatggagcgcgcgtcctgcttgttgctgctgctgctgccgctggtgcacgtctctgcgaccacgccagaaccttgtgagctggacgatgaagatttccgctgcgtctgcaacttctccgaacctcagcccgactggtccgaagccttccagtgtgtgtctgcagtagaggtggagatccatgccggcggtctcaacctagagccgtttctaaagcgcgtcgatgcggacgccgacccgcggcagtatgctgacacggtcaaggctctccgcgtgcggcggctcacagtgggagccgcacaggttcctgctcagctactggtaggcgccctgcgtgtgctagcgtactcccgcctcaaggaactgacgctcgaggacctaaagataaccggcaccatgcctccgctgcctctggaagccacaggacttgcactttccagcttgcgcctacgcaacgtgtcgtgggcgacagggcgttcttggctcgccgagctgcagcagtggctcaagccaggcctcaaggtactgagcattgcccaagcacactcgcctgccttttcctgcgaacaggttcgcgccttcccggcccttaccagcctagacctgtctgacaatcctggactgggcgaacgcggactgatggcggctctctgtccccacaagttcccggccatccagaatctagcgctgcgcaacacaggaatggagacgcccacaggcgtgtgcgccgcactggcggcggcaggtgtgcagccccacagcctagacctcagccacaactcgctgcgcgccaccgtaaaccctagcgctccgagatgcatgtggtccagcgccctgaactccctcaatctgtcgttcgctgggctggaacaggtgcctaaaggactgccagccaagctcagagtgctcgatctcagctgcaacagactgaacagggcgccgcagcctgacgagctgcccgaggtggataacctgacactggacgggaatcccttcctggtccctggaactgccctcccccacgagggctcaatgaactccggcgtggtcccagcctgtgcacgttcgaccctgtcggtgggggtgtcgggaaccctggtgctgctccaaggggcccggggctttgcctaagatccaagacagaataatgaatggactcaaactgccttggcttcaggggagtcccgtcaggacgttgaggacttttcgaccaattcaaccctttgccccacctttattaaaatcttaaacaacgggtcaaaaaaaaaaaaa

SEQ ID NO: 302 - protein, 375 aa, Artificial Sequence
  CD14
MERASCLLLLLLPLVHVSATTPEPCELDDEDFRCVCNFSEPQPDWSEAFQCVSAVEVEIHAGGLNLEPFLKRVDADADPRQYADTVKALRVRRLTVGAAQVPAQLLVGALRVLAYSRLKELTLEDLKITGTMPPLPLEATGLALSSLRLRNVSWATGRSWLAELQQWLKPGLKVLSIAQAHSPAFSCEQVRAFPALTSLDLSDNPGLGERGLMAALCPHKFPAIQNLALRNTGMETPTGVCAALAAAGVQPHSLDLSHNSLRATVNPSAPRCMWSSALNSLNLSFAGLEQVPKGLPAKLRVLDLSCNRLNRAPQPDELPEVDNLTLDGNPFLVPGTALPHEGSMNSGVVPACARSTLSVGVSGTLVLLQGARGFA

SEQ ID NO: 303 - DNA, 3863 bp, Artificial Sequence
  F13A1
atttaagagccaactgtcttgtctttcccgagtccgtttgaggaagtccccgaggcgcacagagcaagcccacgcgagggcacctctggaggggagcgcctgcaggaccttgtaaagtcaaaaatgtcagaaacttccaggaccgcctttggaggcagaagagcagttccacccaataactctaatgcagcggaagatgacctgcccacagtggagcttcagggcgtggtgccccggggcgtcaacctgcaagagtttcttaatgtcacgagcgttcacctgttcaaggagagatgggacactaacaaggtggaccaccacactgacaagtatgaaaacaacaagctgattgtccgcagagggcagtctttctatgtgcagattgacttcagtcgtccatatgaccccagaagggatctcttcagggtggaatacgtcattggtcgctacccacaggagaacaagggaacctacatcccagtgcctatagtctcagagttacaaagtggaaagtggggggccaagattgtcatgagagaggacaggtctgtgcggctgtccatccagtcttcccccaaatgtattgtggggaaattccgcatgtatgttgctgtctggactccctatggcgtacttcgaaccagtcgaaacccagaaacagacacgtacattctcttcaatccttggtgtgaagatgatgctgtgtatctggacaatgagaaagaaagagaagagtatgtcctgaatgacatcggggtaattttttatggagaggtcaatgacatcaagaccagaagctggagctatggtcagtttgaagatggcatcctggacacttgcctgtatgtgatggacagagcacaaatggacctctctggaagagggaatcccatcaaagtcagccgtgtggggtctgcaatggtgaatgccaaagatgacgaaggtgtcctcgttggatcctgggacaatatctatgcctatggcgtccccccatcggcctggactggaagcgttgacattctattggaataccggagctctgagaatccagtccggtatggccaatgctgggtttttgctggtgtctttaacacatttttacgatgccttggaataccagcaagaattgttaccaattatttctctgcccatgataatgatgccaatttgcaaatggacatcttcctggaagaagatgggaacgtgaattccaaactcaccaaggattcagtgtggaactaccactgctggaatgaagcatggatgacaaggcctgaccttcctgttggatttggaggctggcaagctgtggacagcaccccccaggaaaatagcgatggcatgtatcggtgtggccccgcctcggttcaagccatcaagcacggccatgtctgcttccaatttgatgcaccttttgtttttgcagaggtcaacagcgacctcatttacattacagctaagaaagatggcactcatgtggtggaaaatgtggatgccacccacattgggaaattaattgtgaccaaacaaattggaggagatggcatgatggatattactgatacttacaaattccaagaaggtcaagaagaagagagattggccctagaaactgccctgatgtacggagctaaaaagcccctcaacacagaaggtgtcatgaaatcaaggtccaacgttgacatggactttgaagtggaaaatgctgtgctgggaaaagacttcaagctctccatcaccttccggaacaacagccacaaccgttacaccatcacagcttatctctcagccaacatcaccttctacaccggggtcccgaaggcagaattcaagaaggagacgttcgacgtgacgctggagcccttgtccttcaagaaagaggcggtgctgatccaagccggcgagtacatgggtcagctgctggaacaagcgtccctgcacttctttgtcacagctcgcatcaatgagaccagggatgttctggccaagcaaaagtccaccgtgctaaccatccctgagatcatcatcaaggtccgtggcactcaggtagttggttctgacatgactgtgacagttgagtttaccaatcctttaaaagaaaccctgcgaaatgtctgggtacacctggatggtcctggagtaacaagaccaatgaagaagatgttccgtgaaatccggcccaactccaccgtgcagtgggaagaagtgtgccggccctgggtctctgggcatcggaagctgatagccagcatgagcagtgactccctgagacatgtgtatggcgagctggacgtgcagattcaaagacgaccttccatgtgaatgcacaggaagctgagatgaaccctggcatttggcctcttgtagtcttggctaaggaaattctaacgcaaaaatagctcttgctttgacttaggtgtgaagacccagacaggactgcagagggctccagagtggagatcccacatatttcaaaaacatgcttttccaaacccaggctattcggcaaggaagttagtttttaatctctccaccttccaaagagtgctaagcattagctttaattaagctctcatagctcataagagtaacagtcatcatttatcatcacaaatggctacatctccaaatatcagtgggctctcttaccagggagatttgctcaatacctggcctcatttaaaacaagacttcagattccccactcagccttttgggaataatagcacatgatttgggctctagaattccagtcccctttctcggggtcaggttctaccctccatgtgagaatatttttcccaggactagagcacaacataatttttatttttggcaaagccagaaaaagatctttcattttgcacctgcagccaagcaaatgcctgccaaattttagatttaccttgttagaagaggtggccccatattaacaaattgcatttgtgggaaacttaaccacctacaaggagataagaaagcaggtgcaacactcaagtctattgaataatgtagttttgtgatgcattttatagaatgtgtcacactgtggcctgatcagcaggagccaatatcccttactttaaccctttctgggatgcaatactaggaagtaaagtgaagaatttatctctttagttagtgattatatttcacccatctctcaggaatcatctcctttgcagaatgatgcaggttcaggtcccctttcagagatataataagcccaacaagttgaagaagctggcggatctagtgaccagatatatagaaggactgcagccactgattctctcttgtccttcacatcacccatgttgagacctcagcttggcactcaggtgctgaagggtaatatggactcagccttgcaaatagccagtgctagttctgacccaaccacagaggatgctgacatcatttgtattatgttccaaggctactacagagaaggctgcctgctatgtatttgcaaggctgatttatggtcagaatttccctctgatatgtctagggtgtgatttaggtcagtagactgtgattcttagcaaaaaatgaacagtgataagtatactgggggcaaaatcagaatggaatgctctggtctatataaccacatttctaagcctttgagactgttcctgagccttcagcactaacctatgagggtgagctggtcccctctatatatacatcatacttaactttactaagtaatctcacagcatttgccaagtctcccaatatccaattttaaaatgaaatgcattttgctagacagttaaactggcttaacttagtatattattattaattacaatgtaatagaagcttaaaataaagttaaactgattatatttgca

SEQ ID NO: 304 - protein, 732 aa, Artificial Sequence
  F13A1
MSETSRTAFGGRRAVPPNNSNAAEDDLPTVELQGVVPRGVNLQEFLNVTSVHLFKERWDTNKVDHHTDKYENNKLIVRRGQSFYVQIDFSRPYDPRRDLFRVEYVIGRYPQENKGTYIPVPIVSELQSGKWGAKIVMREDRSVRLSIQSSPKCIVGKFRMYVAVWTPYGVLRTSRNPETDTYILFNPWCEDDAVYLDNEKEREEYVLNDIGVIFYGEVNDIKTRSWSYGQFEDGILDTCLYVMDRAQMDLSGRGNPIKVSRVGSAMVNAKDDEGVLVGSWDNIYAYGVPPSAWTGSVDILLEYRSSENPVRYGQCWVFAGVFNTFLRCLGIPARIVTNYFSAHDNDANLQMDIFLEEDGNVNSKLTKDSVWNYHCWNEAWMTRPDLPVGFGGWQAVDSTPQENSDGMYRCGPASVQAIKHGHVCFQFDAPFVFAEVNSDLIYITAKKDGTHVVENVDATHIGKLIVTKQIGGDGMMDITDTYKFQEGQEEERLALETALMYGAKKPLNTEGVMKSRSNVDMDFEVENAVLGKDFKLSITFRNNSHNRYTITAYLSANITFYTGVPKAEFKKETFDVTLEPLSFKKEAVLIQAGEYMGQLLEQASLHFFVTARINETRDVLAKQKSTVLTIPEIIIKVRGTQVVGSDMTVTVEFTNPLKETLRNVWVHLDGPGVTRPMKKMFREIRPNSTVQWEEVCRPWVSGHRKLIASMSSDSLRHVYGELDVQIQRRPSM

SEQ ID NO: 305 - DNA, 4268 bp, Artificial Sequence
  FGL2
gccctgcgcactccctgctggggtgagcagcactgtaaagatgaagctggctaactggtactggctgagctcagctgttcttgccacttacggttttttggttgtggcaaacaatgaaacagaggaaattaaagatgaaagagcaaaggatgtctgcccagtgagactagaaagcagagggaaatgcgaagaggcaggggagtgcccctaccaggtaagcctgccccccttgactattcagctcccgaagcaattcagcaggatcgaggaggtgttcaaagaagtccaaaacctcaaggaaatcgtaaatagtctaaagaaatcttgccaagactgcaagctgcaggctgatgacaacggagacccaggcagaaacggactgttgttacccagtacaggagccccgggagaggttggtgataacagagttagagaattagagagtgaggttaacaagctgtcctctgagctaaagaatgccaaagaggagatcaatgtacttcatggtcgcctggagaagctgaatcttgtaaatatgaacaacatagaaaattatgttgacagcaaagtggcaaatctaacatttgttgtcaatagtttggatggcaaatgttcaaagtgtcccagccaagaacaaatacagtcacgtccagttcaacatctaatatataaagattgctctgactactacgcaataggcaaaagaagcagtgagacctacagagttacacctgatcccaaaaatagtagctttgaagtttactgtgacatggagaccatggggggaggctggacagtgctgcaggcacgtctcgatgggagcaccaacttcaccagaacatggcaagactacaaagcaggctttggaaacctcagaagggaattttggctggggaacgataaaattcatcttctgaccaagagtaaggaaatgattctgagaatagatcttgaagactttaatggtgtcgaactatatgccttgtatgatcagttttatgtggctaatgagtttctcaaatatcgtttacacgttggtaactataatggcacagctggagatgcattacgtttcaacaaacattacaaccacgatctgaagtttttcaccactccagataaagacaatgatcgatatccttctgggaactgtgggctgtactacagttcaggctggtggtttgatgcatgtctttctgcaaacttaaatggcaaatattatcaccaaaaatacagaggtgtccgtaatgggattttctggggtacctggcctggtgtaagtgaggcacaccctggtggctacaagtcctccttcaaagaggctaagatgatgatcagacccaagcactttaagccataaatcactctgttcattcctccaggtattcgttatctaatagggcaattaattccttcagcactttagaatatgccttgtttcatatttttcatagctaaaaaatgatgtctgacggctaggttcttatgctacacagcatttgaaataaagctgaaaaacaatgcattttaaaggagtcctttgttgttatgctgttatccaatgaacacttgcaagcaattagcaatattgagaattatacattagatttacaattcttttaatttctattgaaactttttctattgcttgtattacttgctgtatttaaaaaataattgttggctgggtgtggtagctcacgcctgtaatcccagcactttggaatgtcaaggcaggcagatcacttgaggtcaggagtttgagaccagcctggccaaacatgtgaaacgctgtctctattaaaaatacaaaaattagccgggcatggtggtacatgcctgtaatcctagctacttgggaggctgaggcaggagaatcgcttgaacctgagaggaagaggttgcagtgagccaagactgagccactgcactccagcatgggtgacagagaaaactctgtctcaaacaaaaaaataataaaatttattcagtaggctggattctacacaaagtaatctgtatttgggccatgatttaagcacatctgaaggtatatcactcttttcaggctataattatttgggtaatcttcattctgagacaaacttaatctatatcatttactttgcaacagaacaaccctacagcattttggttcccagactaagggaactaatatctatataattaaacttgttcatttatcattcatgaaatataaaatacttgtcatttaaaccgtttaaaaatgtggtagcataatgtcaccccaaaaagcattcagaaagcaatgtaactgtgaagaccagggtttaaaggtaattcatttatagtttataactccttagatgtttgatgttgaaaactgctttaacatgaaaattatcttcctctgctctgtgtgaacaatagcttttaatttaagattgctcactactgtactagactactggtaggtttttttggggggggtgggtagggatatgtgggtaatgaagcatttacttacaggctatcatactctgaggccaattttatctccaaagcaataatatcattaagtgattcacttcatagaaggctaagtttctctaggacagatagaaaacatgaattttgaaatatatagaacagtagttaaaatactatatatttcaaccctggctggtagattgcttattttactatcagaaactaaaagatagatttttacccaaacagaagtatctgtaatttttataattcatcaattctggaatgctatatataatatttaaaagactttttaaatgtgtttaatttcatcatcgtaaaaagggatcatctcagagagaacagcagtattctgcgtatttttaaaaatgctctagagtaacatttgaagtaattcactgtagtgtatgccagtcctagaaataatttttttaatttctggtgtctgtttctaatacactaaccaagttttcaaaatatatttacaaagatgcatctttacccattattttaaaatgattaaggaggatagttgcttcaggtaacaagctaatttttcaaatattaggcccttacagaactatttagtcaaaaagtaagatattcctttaaaatatataacccaaagctttcagttaaacatgatatatcacaaatactattaaaatgttaaagagaaatgcaaatagcattaaatgatgaccaaaatgtaaaatattgtagatttcaaaagctgtgtctctattaggtgggataccaaatgtaaatgatgtaactgacgttgttttttactttttactttttaaaaaagactaaaaacgttttgatattatacaatgtatttgtttcagataaggtcattgtcatttagtatatataattaatatatgtacaagtttaagtaaattcctgtgagtaaaaatggacttatcacaaaacatagttctaaagaaaggtatatgctcatatacacggtgtccattaatttaatgggaactaggtataacttcaggagaatttggcaaataattcattaatccatgtaaatattcaaaagcttgttctatccacattatttcaagggatcactttatttttcattatactttcacagcacttttctagtaaattctgtaacacagaaattccattttggaatcatttcatgttaccaataattctagacttttataacatttaacatgttgatggaaatagattacatctgctagaaccttttgccttaactattcaccaatatatgctaatattcataaatatggattgactgtttacaaacattagaatcttgtcttggttccattttgatggctaatatttgttatcttaattaagactatttctgaggtcatgattacttgaaaatattgactaaaactgggtccttagaaattccaggtggagctgatttacctatgactgaggggaaaaaaaaatcaaattttactgataatagtaatgctccaaatgaattaatgacacatctgttcaataaataaagagcttaaatatacaaaacataagaaatctgggcaacaaaacttgtggtctttacttttgaatagctacccaagaaaaggttttaaaggtaaaagttatgagtaatgtcatcacaataagctcttgtttaaaattcttttcttttatgtataattaggtttatgtttcatgtctttttaaaaccttataaaagatttaattatcacatctattcttcaatgtggaaatattaaatattgttggttgtaaaataa

SEQ ID NO: 306 - protein, 439 aa, Artificial Sequence
  FGL2
MKLANWYWLSSAVLATYGFLVVANNETEEIKDERAKDVCPVRLESRGKCEEAGECPYQVSLPPLTIQLPKQFSRIEEVFKEVQNLKEIVNSLKKSCQDCKLQADDNGDPGRNGLLLPSTGAPGEVGDNRVRELESEVNKLSSELKNAKEEINVLHGRLEKLNLVNMNNIENYVDSKVANLTFVVNSLDGKCSKCPSQEQIQSRPVQHLIYKDCSDYYAIGKRSSETYRVTPDPKNSSFEVYCDMETMGGGWTVLQARLDGSTNFTRTWQDYKAGFGNLRREFWLGNDKIHLLTKSKEMILRIDLEDFNGVELYALYDQFYVANEFLKYRLHVGNYNGTAGDALRFNKHYNHDLKFFTTPDKDNDRYPSGNCGLYYSSGWWFDACLSANLNGKYYHQKYRGVRNGIFWGTWPGVSEAHPGGYKSSFKEAKMMIRPKHFKP

SEQ ID NO: 307 - DNA, 882 bp, Artificial Sequence
  FOLR3
gagcaagctggtgtcagagcctggacctacagcgctgttggtggaggtcctgcctccaggaatagatggacatggcctggcagatgatgcagctgctgcttctggctttggtgactgctgcggggagtgcccagcccaggagtgcgcgggccaggacggacctgctcaatgtctgcatgaacgccaagcaccacaagacacagcccagccccgaggacgagctgtatggccagtgcagtccctggaagaagaatgcctgctgcacggccagcaccagccaggagctgcacaaggacacctcccgcctgtacaactttaactgggatcactgtggtaagatggaacccacctgcaagcgccactttatccaggacagctgtctctatgagtgctcacccaacctggggccctggatccggcaggtcaaccagagctggcgcaaagagcgcattctgaacgtgcccctgtgcaaagaggactgtgagcgctggtgggaggactgtcgcacctcctacacctgcaaaagcaactggcacaaaggctggaattggacctcagggattaatgagtgtccggccggggccctctgcagcacctttgagtcctacttccccactccagccgccctttgtgaaggcctctggagccactccttcaaggtcagcaactatagtcgagggagcggccgctgcatccagatgtggtttgactcagcccagggcaaccccaatgaggaggtggccaagttctatgctgcggccatgaatgctggggccccgtctcgtgggattattgattcctgatccaagaagggtcctctggggttcttccaacaacctattctaatagacaaatccacatgtgaaaaaaaaaaaaaaaaaa

SEQ ID NO: 308 - protein, 245 aa, Artificial Sequence
  FOLR3
MDMAWQMMQLLLLALVTAAGSAQPRSARARTDLLNVCMNAKHHKTQPSPEDELYGQCSPWKKNACCTASTSQELHKDTSRLYNFNWDHCGKMEPTCKRHFIQDSCLYECSPNLGPWIRQVNQSWRKERILNVPLCKEDCERWWEDCRTSYTCKSNWHKGWNWTSGINECPAGALCSTFESYFPTPAALCEGLWSHSFKVSNYSRGSGRCIQMWFDSAQGNPNEEVAKFYAAAMNAGAPSRGIIDS

SEQ ID NO: 309 - DNA, 3444 bp, Artificial Sequence
  MX1
cgagcagaaatgaaaccgaaactgaattgtccgggaaattcgcggtgggggcggagagcgcagggagaagtaagcccagtgcaggatcctgaggcccgtgtttgcaggaccagggccggccttccgattccccattcattccagaagcaccgaaccacgctgtgcccggatcccaagtgcagcggcacccagcgtgggcctggggttgccggttgacccggtcctcagcctggtagcagaggccaggccagtgccacaaggcacctaagtccacctgggcctggagcaggacaggttgcaaaagaaaatatctcgggacccccaaactccttatgctaagggaaacatcgagcctgggaactgagccatcaacgctgccattctttttcccaaacagaaccctgttgtcagaggtacacccagagcaactccacaccgggtgcatgccacagcaactccatcttaaataggagctggtaaaacgaggctgatacctactgggctgcattcccagacggcatagcgaggaggtgctgaagagcgcaggtttggagaatgatcacctggattggaaccatagctctaccaatatggaacccagctccttaggcctcggtcttctcatggagaacatggtgtgataatcctactcctctgggagggtggctgttaagccttggaccgcagttgccggccaggaatcccagtgtcacggtggacacgcctccctcgcgcccttgccgcccacctgctcacccagctcaggggctttggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacatcgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaagttaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccagtccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcagacaaaaaaaaaaaaaaaaaa

SEQ ID NO: 310 - protein, 662 aa, Artificial Sequence
  MX1
MVVSEVDIAKADPAAASHPLLLNGDATVAQKNPGSVAENNLCSQYEEKVRPCIDLIDSLRALGVEQDLALPAIAVIGDQSSGKSSVLEALSGVALPRGSGIVTRCPLVLKLKKLVNEDKWRGKVSYQDYEIEISDASEVEKEINKAQNAIAGEGMGISHELITLEISSRDVPDLTLIDLPGITRVAVGNQPADIGYKIKTLIKKYIQRQETISLVVVPSNVDIATTEALSMAQEVDPEGDRTIGILTKPDLVDKGTEDKVVDVVRNLVFHLKKGYMIVKCRGQQEIQDQLSLSEALQREKIFFENHPYFRDLLEEGKATVPCLAEKLTSELITHICKSLPLLENQIKETHQRITEELQKYGVDIPEDENEKMFFLIDKVNAFNQDITALMQGEETVGEEDIRLFTRLRHEFHKWSTIIENNFQEGHKILSRKIQKFENQYRGRELPGFVNYRTFETIVKQQIKALEEPAVDMLHTVTDMVRLAFTDVSIKNFEEFFNLHRTAKSKIEDIRAEQEREGEKLIRLHFQMEQIVYCQDQVYRGALQKVREKELEEEKKKKSWDFGAFQSSSATDSSMEEIFQHLMAYHQEASKRISSHIPLIIQFFMLQTYGQQLQKAMLQLLQDKDTYSWLLKERSDTSDKRKFLKERLARLTQARRRLAQFPG

SEQ ID NO: 311 - DNA, 834 bp, Artificial Sequence
  PSENEN
atgcgtgcagtgttgcctcgcccaaagaagactacaatctccagggaaacctggggcgtctcgcgcaaacgtccataactgaaagtagctaaggcaccccagccggaggaagtgagctctcctggggcgtggttgttcgtgatccttgcatctgttacttagggtcaaggcttgggtcttgccccgcagacccttgggacgacccggccccagcgcagctatgaacctggagcgagtgtccaatgaggagaaattgaacctgtgccggaagtactacctgggggggtttgctttcctgccttttctctggttggtcaacatcttctggttcttccgagaggccttccttgtcccagcctacacagaacagagccaaatcaaaggctatgtctggcgctcagctgtgggcttcctcttctgggtgatagtgctcacctcctggatcaccatcttccagatctaccggccccgctggggtgcccttggggactacctctccttcaccatacccctgggcaccccctgacaacttctgcacatactggggccctgcttattctcccaggacaggctccttaaagcagaggagcctgtcctgggagccccttctcaaactcctaagacttgttttcatgtcccacgttctctgctgacatcccccaataaaggaccctaactttcgatactgacttcctgggatcttttagaggttgaggcataaatgattattaatatttaaaaacatctgttgagagctttgtacgaggcttagtatttagacatgatgtacattttttacagtgcatactactcataatcttctgaactaggaac

SEQ ID NO: 312 - protein, 101 aa, Artificial Sequence
  PSENEN
MNLERVSNEEKLNLCRKYYLGGFAFLPFLWLVNIFWFFREAFLVPAYTEQSQIKGYVWRSAVGFLFWVIVLTSWITIFQIYRPRWGALGDYLSFTIPLGTP

SEQ ID NO: 313 - DNA, 836 bp, Artificial Sequence
  IFI6
ccagccttcagccggagaaccgtttactcgctgctgtgcccatctatcagcaggctccgggctgaagattgcttctcttctctcctccaaggtctagtgacggagcccgcgcgcggcgccaccatgcggcagaaggcggtatcgcttttcttgtgctacctgctgctcttcacttgcagtggggtggaggcaggtaagaaaaagtgctcggagagctcggacagcggctccgggttctggaaggccctgaccttcatggccgtcggaggaggactcgcagtcgccgggctgcccgcgctgggcttcaccggcgccggcatcgcggccaactcggtggctgcctcgctgatgagctggtctgcgatcctgaatgggggcggcgtgcccgccggggggctagtggccacgctgcagagcctcggggctggtggcagcagcgtcgtcataggtaatattggtgccctgatgggctacgccacccacaagtatctcgatagtgaggaggatgaggagtagccagcagctcccagaacctcttcttccttcttggcctaactcttccagttaggatctagaactttgcctttttttttttttttttttttttgagatgggttctcactatattgtccaggctagagtgcagtggctattcacagatgcgaacatagtacactgcagcctccaactcctagcctcaagtgatcctcctgtctcaacctcccaagtaggattacaagcatgcgccgacgatgcccagaatccagaactttgtctatcactctccccaacaacctagatgtgaaaacagaataaacttcacccagaaaacactt

SEQ ID NO: 314 - protein, 130 aa, Artificial Sequence
  IFI6
MRQKAVSLFLCYLLLFTCSGVEAGKKKCSESSDSGSGFWKALTFMAVGGGLAVAGLPALGFTGAGIAANSVAASLMSWSAILNGGGVPAGGLVATLQSLGAGGSSVVIGNIGALMGYATHKYLDSEEDEE

SEQ ID NO: 315 - DNA, 1968 bp, Artificial Sequence
  HS3ST2
cgcagggccacagcagctcagccgccggtgccccctcggaaaccatgacccccggcgcgggcccatggagccatggcctatagggtcctgggccgcgcggggccacctcagccgcggagggcgcgcaggctgctcttcgccttcacgctctcgctctcctgcacttacctgtgttacagcttcctgtgctgctgcgacgacctgggtcggagccgcctcctcggcgcgcctcgctgcctccgcggccccagcgcgggcggccagaaacttctccagaagtcccgcccctgtgatccctccgggccgacgcccagcgagcccagcgctcccagcgcgcccgccgccgccgtgcccgcccctcgcctctccggttccaaccactccggctcacccaagctgggtaccaagcggttgccccaagccctcattgtgggcgtgaagaaggggggcacccgggccgtgctggagtttatccgagtacacccggacgtgcgggccttgggcacggaaccccacttctttgacaggaactacggccgcgggctggattggtacaggagcctgatgcccaggaccctcgagagccagatcacgctggagaagacgcccagctactttgtcactcaagaggctcctcgacgcatcttcaacatgtcccgagacaccaagctgatcgtggttgtgcggaaccctgtgacccgtgccatctctgattacacgcagacactctccaagaagcccgacatcccgacctttgagggcctctccttccgcaaccgcaccctgggcctggtggacgtgtcatggaacgccatccgcatcggcatgtacgtgctgcacctggagagctggctgcagtacttcccgctagctcagattcacttcgtcagtggcgagcgactcatcactgacccggccggcgagatggggcgagtccaggacttcctgggcattaagagattcatcacggacaagcacttctatttcaacaagaccaaaggattcccttgcttgaaaaaaacagaatcgagcctcctgcctcgatgcttgggcaaatcaaaagggagaactcatgtacagattgatcctgaagtgatagaccagctccgagaattttatagaccgtataatatcaaattttatgaaaccgttgggcaggacttcaggtgggaataagcccacgaaaggaaagggctctcaagggctcttctgctcatctcttccgtgagatttgctcccagaccctctgatctccctccaacaaaccctggctccagccccctttcccaacttgagttgcatcatcttggaaccaggaagcccagctaaagccaagagaccagagagtccctgccactagttttcatcagtctgttcaagcaaagttgatctgctcctggcacgtccagtaaattccagaatcattctcctttctgcccataaagggccttggagaattgctttaagaagagtgaatgttccaatgatgatagatattataagcgatgatggttctgttgctatgaacacagcagtcggtccctgtcattgtccacccaggagtggccttgttaattccaagtggcatgtatcttccctctgagcttcatttcttcaagatgctctgggtggtgggatgggagaccatcctcagccctcctcagaccttatcaattcattgagagattgcaaagctgaaagcacctccggccactcctgggagacagaccctttggtgatgaaataaaccagtgacttcagagcctatggtctcaactgtgcttgaaaaacactgtctctgaaaacaactttgtgattctccctgctccctgtggacaaaagcacataattctgctgttacgggtactttgctcatacgagctttcatgttcagcatgcaatggaatcatgcttgtccatgtgaaataaatatggctctctcgtgtccttaaaaaaaaaaaaaaaaaa

SEQ ID NO: 316 - protein, 367 aa, Artificial Sequence
  HS3ST2
MAYRVLGRAGPPQPRRARRLLFAFTLSLSCTYLCYSFLCCCDDLGRSRLLGAPRCLRGPSAGGQKLLQKSRPCDPSGPTPSEPSAPSAPAAAVPAPRLSGSNHSGSPKLGTKRLPQALIVGVKKGGTRAVLEFIRVHPDVRALGTEPHFFDRNYGRGLDWYRSLMPRTLESQITLEKTPSYFVTQEAPRRIFNMSRDTKLIVVVRNPVTRAISDYTQTLSKKPDIPTFEGLSFRNRTLGLVDVSWNAIRIGMYVLHLESWLQYFPLAQIHFVSGERLITDPAGEMGRVQDFLGIKRFITDKHFYFNKTKGFPCLKKTESSLLPRCLGKSKGRTHVQIDPEVIDQLREFYRPYNIKFYETVGQDFRWE

SEQ ID NO: 317 - DNA, 1503 bp, Artificial Sequence
  TAGLN3
gtgcagctgctggcctcgtagacaatcggctgtctccccagaagagggaaagaattgtgcagatgagaaagaggctctcagcgggagggaggcaggcgggcttgattgacacaggagagggctggctttttggagggctcttagcaacggccctggttgagccccctcagccatgagaaaatcaaatcaatgtgccattcttccaggcgcgaggcagcagcggctgcagttcaacatgaaaggaggcttcctccctgcctgctaattacctgctcttcccgatctcatcgtttctgcctttgcaaagtgctactgagaagggggaagaaacgtccgccacccatcccccttgctgcctgggggttcagacttgattgtgaaaccccattggcttcattggctccttgatttaaaccacgcccggctttctgccctctttgctgctgctgggccaggttgcccagccatatcccagccccgtctgcagggagccggaggctgctgctgctgctattgtgtggatgccgcgcgtgtcttctcttctttccagagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcagggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcagctgtgcagaggaccctgatggctttaggcagcgttgcagtcaccaaggatgatggctgctatcggggagagccatcctggtttcacaggaaagcccagcagaatcggagaggcttttccgaggagcagcttcgccagggacagaacgtaataggcctgcagatgggcagcaacaagggagcctcccaggcgggcatgacagggtacgggatgcccaggcagatcatgtaggacgcggcatcctgcccctggtagagaggacgaatgttccacaccatggtctctacgaaaaagaaatagttagtcaccttctgaccttctcctctttctcaaagccttctgtccctggtttttgcaagtgctgcatttccgccgagaatccgcgttgcctactgctgccacctcctgttcatttagaactatgcaaagactccgcttccgttttcctgagctcctcgggccccagagtctctgtttgattatttatttatttatttatttatttgccaaaaattctcctcttcaacttatagaatgcacctaataaagtaattagtcttgtgtcttaaaaaaaaaaaaaaa

SEQ ID NO: 318 - protein, 199 aa, Artificial Sequence
  TAGLN3
MANRGPSYGLSREVQEKIEQKYDADLENKLVDWIILQCAEDIEHPPPGRAHFQKWLMDGTVLCKLINSLYPPGQEPIPKISESKMAFKQMEQISQFLKAAETYGVRTTDIFQTVDLWEGKDMAAVQRTLMALGSVAVTKDDGCYRGEPSWFHRKAQQNRRGFSEEQLRQGQNVIGLQMGSNKGASQAGMTGYGMPRQIM

SEQ ID NO: 319 - DNA, 13028 bp, Artificial Sequence
  SV2B
aggcggggtggagacagcgagacgacgcccatgatcagctggttacaaaactcgaggaataagaagtttaatatttattggtctgcaaatccggagaccttgcggcctcactggtcctccttccctctgagctatctccacacccagccttcgatcagaaggagatttagaagcagagctgcccgcagcgaatacttttaatgcccgggccgggaagaaagcgggttaggatctgatcccgctgagtagaggacccaggagcctcccgccccgcgtgctctgtagcgcgggggcgcgctgcgcgctgcgcctgggcggctggcgggggcggcgtgggcgcggtgatgcaggtgtgacacccgccggcgcctgcctccgcccggatcgcccagctccgcgttagccggagctgcacgcggggctgccggggcggacgctgctctgcctgcatccggaggcggccgccagcggatttgccacccaggtcctaagactctcagtccagagagggccctgccccacacccagaaggaaggaatgctgcccagagatgaccagaggaatctagacagagcataaccttcggtggcaggacaaatcaggccagcacgcagtctgccaagtcctgctcgctccctgtcaagaaaaacagctggatccatttctaatcaacacttcccaacgcaacacttctgagtctctgaaggagaccagagcttgaaactttccagacttccaacagacatcgagtgcaaaaggatatttaggttgtctttgcacaaatctggttgatttgagagataaagggggggggaaccagtgtgactttcacctaagaagtcacatgaacatatttcacatttgaactacataatgaatgatggttattgaaatagcccaaacctctaccacagagcgagggatatagctcaaggggcaaccaggcagtcgcagaaccaaggaatggatgactacaagtatcaggacaattatgggggctatgctcccagtgatggctattaccgcggcaatgagtccaacccagaagaagatgcacagagtgatgtcaccgaaggccatgatgaggaagacgagatctatgagggcgagtaccagggtatccctcacccagatgatgtcaaggccaagcaggccaagatggcgccctccagaatggacagccttcggggccagacagacctgatggctgagaggctggaagatgaggagcagttggcccaccagtacgagaccatcatggatgagtgtggccatggccgcttccagtggatcctctttttcgtcttgggtttggccctgatggccgatggggtggaagtgttcgtggtgagttttgccctgcccagtgcagagaaggacatgtgtctgtccagttccaaaaaaggaatgctagggatgatagtctacttgggaatgatggcgggcgccttcatcctgggaggcctggctgataagctgggaaggaagcgagtcctcagcatgtctctggccgtcaatgcctccttcgcctccctctcttccttcgtgcagggatatggagccttcctcttctgccgactcatctcaggcatcggtattgggggtgctctaccgattgtttttgcctatttttctgaattcttgtctcgggagaagcgaggagaacacctcagttggctgggcatcttctggatgactgggggcctgtacgcatctgccatggcctggagcatcatcccacactatggctggggcttcagcatggggaccaattaccacttccatagctggagagtgtttgtcatcgtctgtgctctgccctgcaccgtgtccatggtggccctgaagttcatgccagagagcccaaggtttctgctagagatgggcaaacatgatgaagcctggatgattctcaagcaagtccatgacaccaacatgagagctaaggggaccccagagaaagtgttcacggtttccaacatcaaaactcccaagcaaatggatgaattcattgagatccaaagttcaacaggaacctggtaccagcgctggctggtcagattcaagaccattttcaagcaggtctgggataatgccctgtactgtgtgatggggccctacagaatgaatacactgattctggccgtggtttggtttgccatggcattcagttactatggactgacagtttggtttcctgatatgatccgctattttcaagatgaagaatacaagtctaaaatgaaggtgttttttggtgagcatgtgtacggcgccacaatcaacttcacgatggaaaatcagatccaccaacatgggaaacttgtgaatgataagttcacaagaatgtactttaaacatgtactctttgaggacacattctttgacgagtgctattttgaagacgtaacatcaacagatacctacttcaaaaattgtaccattgaatcaaccatcttttacaacacagacctctacgagcacaagttcatcaactgtcggtttatcaactccaccttcctggagcagaaggagggctgccacatggacttggagcaagataatgacttcctgatttacctcgtcagcttcctgggcagcctgtctgtcttacccgggaacatcatttctgccctgctcatggatagaattggaaggctcaagatgattggtggctccatgctaatctctgcagtctgctgcttcttcctgttttttggcaacagtgagtctgcaatgatcggctggcagtgcctgttctgtgggacaagcattgcagcctggaatgctctggatgtgatcacagtggagctgtatcccaccaaccagagagcaacagccttcggcattctcaatggattatgcaaatttggcgccatcctgggaaacaccatctttgcttcttttgttgggataaccaaagtggtccccatccttctggctgctgcttctctggttgggggtggcctgattgcccttcgactgccagagactcgagaacaggtcctgatgtgaacaacctatgggaaaaggaaaggtcgagagaatcttgtccaggacactgaaatgcatccacacttcctgcctatcacggtccggaggacaccttggatagcacgggaggagaagttgactttgtgacccctagtttaggacccacttcagctgtcaatatgtttgtaactcaggtgactgatttgggggtgccctgagccacccttagaatcacagagctgcgtgtttaacttcaagtcttcccagtccaaggcagggagaggattctccagtgagtgcacacactatgcgaggagcaagcatttctctaagtcaagtgcaaggacttaacttgcgtttgaaaaggaattagagggtcagaaacacccaggttcctccagaaagctccttggagcccaacaacttaacaaatcaacttggctggaagttagagtcattatatgaagattgggcttgaagtatatatttttgcatttaaaagtatcacctatcatattttccactcgaaaattgacatagtagcattgaggatactctgatctagaaagccaagtatttgagcaacatctatagagatctacttttctcctatgtctcctaggctttccatgataattaggtaatacatttaagaaggatatttatttctgttttgctctattcaaagaaacggaatgggatagttattctgtaaactaagtttgtatataactttatttgggtttaatttccacaactggtatctgcaaatattgccagcattttagccatattttgggagaacttggtgtttgaggtcccaggaaatgaggtctgatcaaatgaaatgcaagcacaatttcttacagccatttaactttctgttgggaggatgaattaacaaactcacattgtgcagtctgcttaatccaggcacttttctttgtgcaggtgtagtgagtagttacttctctcccttacacagatgacttgtgaaactcaagctcaccatcttcagtgctggcattttactttgccactacccaaaaacaatgtgagatgtgttcagtggcctctggtactctttgcaggcaagaatcaaacaacatggggactgagggaaggatggggaagtgtagccacagttcttccaaatgtaaatactttttgtttgttctagtggtaaaatgcaaatgcaatccatatttgttaggatggtcaggtctcatgagaaatctatgctatgtgtccagagcttttgaaacagagtccattggagtgggagttagggagtgtagtggatgccaaatatgtttttcttcagtgcttaagagaactgtttcctgaagtccagctttgaacataaacaggggtgtgggttgggggaggagcttaggacaaacctctctgatgaaggtcagcaatagactgaagtcttgactgcatggaagaggaaaaacatcagaactgtctgacaatggaggggacagtgagctacgcacaactgccagcggaggtgaacttgcacctgcccaggccggatgaacatcagcctgcaagaactagttgtttgagttgatttgcagtgctctcaatgggcaagtgccacattttccctggcagagatctccaaaaatttaaaacagaataataatggctatatcgagtgttttctcagtattggagaaatgcttaggtcctatgatagcttcgggacatctttctgtaattttcctcaattaacgggttggtaggggtaaatcttatgacacctttccaccgtcgatttgagatcagttttaatggttaaaatgtttactctccttctgtcaaccctcacctttttatttacacccctccctttttttctgtacagggagagaagacatattgactctgactggacaccctgattcctccaaatatatataccactgtgtattaatctttctctcagtgttttataggagtactaacatttattgctctgtcaataatgaaaggctcgatgtaatatagctgtaatttactttccatatgaatacagtggctaggttcataaaagagaattgtgtgagtctgggattaccacatctaaaacattattctttaatgggataatacaattcattgagcagctaccacttaaaaaacttgcaggacagttagagcctgcatttctagttaagatggatcttgtaaatttaaaattggattaacattggagtgctggggtggctgcaataatttgggggctaactccatttggtttccaagatctcacttctgcattatctttatggctctttaaaccagccacctagccaatcaagggcaattcccatctcatccatcactcaggtctttgtaaagggtgcagccaagctctgcagacttttgcaggattgtctagcctgagtaccgggctacttcttaaatgccgtcactcctgctgagataaatgcgtctttaaaaatagtctctgtggcaggtcactgggggacaatgtacagcattctggccatccacttctttttcacttcatgttctaccccaagagactcccgatgtcggctgtggagggttaaagggatgaggctttcctttgtttagcaaatctgttcacagttcttgatgatgtattttatgatgcccagcttggaaatagttgctttccatagtctcaactgtattgtgtcatctcctgatgctgatttttgatcttttgttttattaaaaataattagtgaaagaggtgtgcctatctgtgaagtttgtagtacatcatcctgaggtcatgtaacaagtaaaccccaacccagcgttccctcctacgttgtgttagttcattaaaactaaataataaaaataactgtaagaaaaccttaaggactggggttagagattattttcaggcactaaggtctcttctgtattccaaaattgattgaatcagctgggagaaacattgagaatcgcttccttcaacttttattttgcaacatggggaccttgagaggttaaacgatgtggcccagattacatgtaatgtgaggagtgggcgagaaggcctaaggtgatgctctcatgacagttctggggaagcctgcagtttggggaatgggacaatgtgacaaatactcgccattccctgagaccattcattgactattcccttgatggctttactataatgagaggaagcatcagtttaaacataaaaagattagtatttatccatccatttattcattcagcaaatccttattgagccctgaccatgggccagtctctctgccaagccctggggacacagtgatgaaaaaactggccacagtttctgcttcctgcctcattccacttgcagtgagcggatattaaattggccataaacaccgagtacgatgaccttacaatccgcaaactgcacctttcatgtgtaaaaggattgctactactttacttgtcagctgtggatttccaaatgtggtggctccctcttatttttttttctttgaggagtgtaccaattttttatctttataaaccaggtaagggaaatgatgcccttgcccattttctacagacctaatcgatttttacctaatcagttttacagaaagggttacatggaagaagagataggggccaggaatgcaagagggacattggtgagtggggtaagaatccccgtagccctgggaaaggtgtctccacttccacatctggcttttctagggggcatctgtgctaactgacctgggattatgttggatggcatatgactgcaaattcaaagaaaccaatttataataagtttatagtaagttaaaggtttgttttactctcatgtgaagggaatctggaggaaggaaagccagggctggagtggctgcctttgatcatgggagcacactccttctgcccgatcattgggagcacactccttctgcctgatcgttgggagcacactcctgcctgatcatgggcgcacgttccttctgcctgatcgttgggagcacactccttctgcctgatcatgggagcacactccttctgcctgatcattgggagcacgctccttctgcctgatcgttgggagcacactctttctgcctgatcgttgggagcacaccccttctgcctgatcattgggagcacactccttctgcctgatcatgggcacacgctccttctgcccgatcatgggcacacgctccttctgcccgatcgttgggagcacactccttctgcccaatcattgggctcacgctccttctgcccgatcgctgggctcacgctccttctgcccgatcttgggcgcacgctccttctgcccgatcgttgggcgcacgctccttctgcccgatcgttgggcgcatgctccttctgcccgatcgttgggagcacgctcattctgcccgattgttgggagcacgctccttctgcccgatcgttgggcgcacgctccttctgcccgatcgttgggcgcacgcttcttctgcctgatcgttgggcgcacgctccttctgcctgatcgttgggcgcacgctccttctgcctgatcgttgggagcacgctccttctgcctgattgttggaagcacgctccttctgccttcagactccttgatttttagtgcagtttccatcactgaggctgcctcatgggctgagatggctgttgaagcactgaacctcacatccacaattcaggcaggaagcagaaggaagggcaatgggcaaaggggctgtgccttgcagccgatccagcctccctttgctgcagaggaggcagggaaatgcggtatttactgggaacattgctgcccctcctccaaattgagggtcttggctcgaaggacaaaagccagaaaggataggtggattagtgcttcttaaacttttgcgtgcatcagaatcacccagaaagatgttaaaactcactcttcaaggccccatccccagagattcggattctggggatttggaatctggggtggggtctgaagaatctgcattttttaacaaactcccaggtgacatagatggcatcaattctcaagccatattttgagtagcactgacactcttccaataggtggtactttgacttgtcagggaagttctattgctctgataacttaaaaccaacccaaccagaagctcacaaaaactagcagcctgtgaaaaatgatcaccattttcctagagctccgagacaactagtggtagtgcaacagtaacccaaaaatgtcaatgaaaatatttccttccccagaaactgcttggtttcactcaggtcctgtccttatgggcctgtgtctggttgcagggcttgaagtatttcggaagctcagcagaggttgaaccctttcccctgggggttggtgatctttgttttggccatttccacctggtgaagattttcatagacaaatatgcttgtggcatcctgtaattcattgtgccttatgatggacctctgattctataagcttccccctagctagggatgcacgggggtgatcaagacatgactagatgtgaacctgacctgcagacagtccacctgaacgtgcctggaaatgtctcccgaaaaggatgaaaagcctcctcctttagacaaggaagacagagtggagcaaatttctctacatagatctcattcgaaaacaaatttacagaatgcagaatggctactgtgtgtcttgtgctatgctaggtctctctctctctaagtggactctgaccctgtccaaaacattgtgcttttgcatgtagctgtgtcgcatttaggcccagctctaagaaccgtttggaaataaatcacatagagcctttgattgtgaggcaggcttaaagtacattttgtttgatttgcagaggcatggtgaggaatttatatgcatggctgttgtggcagcagcgagatttccaaaaagatgaatgatgaaatgaaacagactgaagctatctcacaaatgttaaatggagaaataaaagttgttatagtcattgctaattacagaatgagcaagagatttatttagcaggaccatactatgccccctggaaggttcagtttatgagctggagcacaaggatttactgtcatttcacctgaaaacacacatttagctgtccatttacctttaatcctacaggcttaaaatactttaaaatttcagagaccattaatatgtattcctttagaaagcaaaggtctttcagaagctgtcctctaccaaagttaatgtggtcaccacatttgatgattttgctaggtagggaggtttatttaatcacagctactgtcactcaggaggatgagccatttaaaaatggtggccctgtcctccacttcttacctaccatatataatctcagtaattcagatttctctaaatcagcattagtgatcatttcaatagggtatgaacaaaaggcctataaaaatagctttccaattcgccaccaaaaatgcaaaaatgacaagtaagtgaggtaacgcatgagctaaatagcttgatttagtcactctaaaatgtgggtgtgtatatatacatacatatatatacacacacacattatgttatacaccataaatatatagaagttttacttgtcaattaaaactataaataaagtggctttccagaaaaattagatattggactctatcacaaaggaattgcataaaaatacttacaaacataactataagcaattgatgagcaaattacaaatgactgttttttattaaaacattcctccaaaagaacggcaaagcaaatcccatagacacccaaaatactaaaagtgacaaaacaatacttctttaaaaatgtattttatgatctatttattgatattctaatggttttaagaaggataattttccaaaacctaaatgctacacattttacagtggcaatatcaaccttatcatgagctaaagatttgcaatcagaacattggtagagtgcattgctgagttataacaagtgtctcaggacgaggatatttggtaggtatccttaaatatatagatgcttaccagtaggtttaatagaagatttctgaaaggtagcgcaagtttttatttcattatttttatttttatttttttgagacagagtctcactctgtcatctaggctggagtgcagtggtgcaatcttggcttgctgcaatctccacctcccaggttcaagcgattctcccacctcagcctcccgagtagctgggattacaggcatgcgccaccatgcctggctaatttttgtatttttagtagagacggggtttcgccatgttggccaggctcgtctcgaactcctggcctcaagtgatctgcccgcctcagcctcccaaagtgctgggattacaaatgtgagctactatgcctggtcccaacttcttaaaattaaattttggggaagttcatggagatatttttgacatgtaaaagtagaaaacaaaccatccatagtgtgtgcatatatacacacaaggtttggtttaatatacttgctgtgcactagtcagttttgattcaggttacataagggataaaatatagaaagacattttaaagtttgaaatatgtgctaagtagttagagatttggcagttttgccacatttcaaatgggccaaacattaaaataacttatccatgaatttcaggtttcaaggaaggaggaatatctgactatttttttttgtgtgtgagatttggtctcagctttttggtccatctgaatcctggaagtccccaactctaccagaccaaaagggtgtctctattttttgttgttacttctctgttcttgatgtaatgagttaagtagatgaaagagattaaggtgcagggaagggctcttaaaagtttaatgtttcagctttccatagtcattcatacttgtgaatcttcttcctcttctacttcaaagtagccaaaacttggaaagttcaaattaatctttgggctccaaagagcaattctgaaggattaacaggtttcattctctccagtgggaggtggcctagacaggtgccggttttggggagaggtgagagtacccagatgtgggtgactatttcctgttcttccctgaaagtcaggccagtggtctcgaatcattcccacagcaactgctacaaaagtgactatcttaatcctttggctagatgggatacctcttctaccttttcagaggtgagctgttgagtagtaatgtccgctacaacaccacgctcccggaatggtggttcctaagagcaaagtcagttaatacaatttctccaggtatccagctatctccaggtgtgcggtcctgtgaagcactctaagaactgtaaaaaatatttcataggtatagaaggcatttgtaatactgttggttcaaatgtgctgacatgtagccagtggaggaagatgtttctttggaagcctgccatctttctgtaacgcaccttcaacctgagataattaagagtcattacgtttcccagtcccatgtcacattgaccagtcctgtggtcctatggctaagcggaggacacggccacaagctgtgagtcatgaaaaggagggtgcaggtgataggcaaagggacccattagccagtttacaatgactggcaactgaccagatagagcttaccgtatgtccatgtagagttgctcatattagtctgtaaataattctatgcatagtgaatgcagcttctgaattattaaactgatgctataaatgtgaactgacaaaacccacttttggtctctcttcatatttttcgtggtttcatttatctctcccttcagatgtttttccatctgactgtcactggatagtggaattgctctgattaccgatgccttttttgttctttggtatattaaaatagtagtaacagttgatctggtgattggtgaatacagtttaatctttaataccttgtgatccagatatttaacaaacacacatgaaatttactgaatgacaagaactgtgataaagacttttaaagcctatcccctttaaccttcataataacctaatgagtaagtgttattttcttccctttagaagtggggaaactggaacacaggaaagtcacttgtcaaaggccaaatagctacagactgagtattccttatcccaaatgtttgggaccagaagtgttctggatttccggttttaaaagattttgggatattggcattatacctaccagctgagcatcccaagtctgcacatttgatatctaaaatactccagtgagcttttccttggagtacacgttggcgctcaaaaagttttcaatttgggagcatttcggatttttgacttttggatttggatttggaatgctcaacctgttttcagagtcagagccaagttctgaatgctcatcacctggcatatagtatggtataatcaccccaccaaacctcttccaaaagaagccagggtcatctgctgcagatgtttctgggccactaggccaatattaaccaaattattatagacaccatcttaatgtagaggatcccacaagactgtgacctaataaaaccctcattttccctatgcattgtgactaacacagtatttgatacgtagtaggtctcaatagatgatgaatagaccgatgaatgagcacatgagttgaatggtgaggagcaagtgaagtgtcatatgtaaaagagttaattctcagattgattcaaatgcggacttaacactgcagctgtaactctgggtccgggtcttggtggctcctgctttgctgagctttaaaactttagtaacctgatgatggagagatctggggggtgcagaggagggacctggttctggagtggtgatgctggttgtcagagggctgagggtggtggccttttgctaactggtatggaagcatttcggtattttaacaagtatgaaagtagctatgtgaatttgccaaatagaaatcttggaggccaggtgcagtggttcacacctgtaatcccagcattttggg

SEQ ID NO: 320 - protein, 683 aa, Artificial Sequence
  SV2B
MDDYKYQDNYGGYAPSDGYYRGNESNPEEDAQSDVTEGHDEEDEIYEGEYQGIPHPDDVKAKQAKMAPSRMDSLRGQTDLMAERLEDEEQLAHQYETIMDECGHGRFQWILFFVLGLALMADGVEVFVVSFALPSAEKDMCLSSSKKGMLGMIVYLGMMAGAFILGGLADKLGRKRVLSMSLAVNASFASLSSFVQGYGAFLFCRLISGIGIGGALPIVFAYFSEFLSREKRGEHLSWLGIFWMTGGLYASAMAWSIIPHYGWGFSMGTNYHFHSWRVFVIVCALPCTVSMVALKFMPESPRFLLEMGKHDEAWMILKQVHDTNMRAKGTPEKVFTVSNIKTPKQMDEFIEIQSSTGTWYQRWLVRFKTIFKQVWDNALYCVMGPYRMNTLILAVVWFAMAFSYYGLTVWFPDMIRYFQDEEYKSKMKVFFGEHVYGATINFTMENQIHQHGKLVNDKFTRMYFKHVLFEDTFFDECYFEDVTSTDTYFKNCTIESTIFYNTDLYEHKFINCRFINSTFLEQKEGCHMDLEQDNDFLIYLVSFLGSLSVLPGNIISALLMDRIGRLKMIGGSMLISAVCCFFLFFGNSESAMIGWQCLFCGTSIAAWNALDVITVELYPTNQRATAFGILNGLCKFGAILGNTIFASFVGITKVVPILLAAASLVGGGLIALRLPETREQVLM

SEQ ID NO: 321 - DNA, 3760 bp, Artificial Sequence
  NCALD
gacggtgctgtccagggggaggcgggcggagggaaggcgctgccgctgctgccgccgcctcgcccgaagcgacacagacgctgggagcggccgaggcgagatcctatcattattttaaaattcctcctcctccacgaagtccttcctgattccttcaaagaaatatcactcctccgaattcccagagtgatttcttctgacttgagcctgcagtgtgctgtgagagatctaccactagattatctcaactttggtctcctgggaccactcgttgctgacagtcagaaattgcagggcatctgatctcctggtgttaaaatctgtcgtgataccgaggaaggccccgagatcccaggcactgagtgactgcatactctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgaatctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttagtagcttattgtgaagtaagacaactataatgaatgtctgtcttgtttggaagtcatatctgtctttgcacaaatgtaccaatcgacaagtatattttatatattccataaaaatacaaagtaaccctgactagggcccaactttaattttgaatgcatttccagagtggccatgcctagagggcagatgcagagcaggtggtagtgggacaggacaattggagcacaggaatgttaacatgtatgacaggggaccagtagggtggtttccctctcaggcccagcagcccattgacagcattagactggcggcatggtgcttttctgagcagatcaatactctgcagactcgaaaaaacatcacatacattcttggaacttcccagtggtttaatctatgtgcatggttagggagccaggtctggaatattcagtttccctgcccctgttaaagaatcagaggttgggcagtcatcaaattcatcataaagacatgggcaagtgtgtctgtggtttccaaggcccccctatggagaatccaaaagtattttccattgccgtgctctttgaatgcagacttctatttccagaagtgacagcacaagtctgagttgctgtttggtctggtgacctcagacacactaatttgaattgaaagctaagagtaaaaatttgctggttacaggcgagtcatactcttgcaagtagttagcaaagggaggcccaaattctcaaggttgttgatggggaacttgccactaagagaaggcagagaggtccctagtgggtatatttgctgccaagccacttgccaaagaagaggaaccacagaaagagagacatcatgaccaggagaaaaatgtgactagacatgctaacctccaggtttttatatatgacttgagtctgctgtaattggcagcagaaatccaaatttgtatggtagaccaaaaagaaccaaatccatagggtgaaattttgagacctagactctgtaaaaataatcctagtcttcctccaggggtcagttcctcacagtggttctgtaccaaaacttgccaaattcctccatggccaagtgttaaaatctgtgtttggaaaatagcgaattaacctaagacacagaaggcagactgggtgaggagacctagcatgccctattggcagtgctcaggagctgcatcccacttttccctgctctgaatcgaagtcctagttccttcctttgattctcctttggtaggtggaatcagttaatgttttgagaaacctgcctgggctctgcccttagtcatgacatctcgctgagccagacccactctgttccttggaacctagagctggagtgaggagtagaggtctccggctattccagaaagaaaagtgagccacatgcaggctgatgaatgccgacacttccagaatgtatagaaatagtccctgtcctggcctgccactgaccctgtctgtattttctcggaggttgtttttctccttctccttcccaggaaggtctttgtatgtcgaatccagtgcactcaagtttggccaagggactccacagcacccagaagactgcatgcctcaaggtttatgtcactcctctgctgggctgttcattgtcattgctgtgttcagggacctttggaaataaaacctgttctgtcccaaataaaaccagcctgtgatgttcaagggactggaataaagtggcttacgacctgaaggattctacagagtgctcaactgttcatacatcattcagagtgggagggagctgggggtgctgtcccatcccatctgtatgcccacggtggatttaataatatataatttataaatcatagcctatggagtggcccgtaaatcagttgactgtgtagctcttgcctggcattaaagcatgtttttggtttaacatgaaaaaaaaaaaaaaaaaa

SEQ ID NO: 322 - protein, 193 aa, Artificial Sequence [sequence omitted]

SEQ ID NO: 323 - DNA, 5520 bp, Artificial Sequence
  ENC1
agagtccagccgggggtgccgcacccactggggagtggggagggaggacacataggaaatgcctggggctggagtctctttggctctctgccagcaagaaacttaaacgtcctggcttgctcaacccgagtgtccctaaactgtccagacttttgcccgtccattgccactatctctccccactctgggtgtcctacccaaggcgctgtctatgcgtgcccagggcctgtcctgcggatacccagctcgccccttgcagccctttttagagcatctcgcgggctctggcatcaccaagcgcacagccccgggctgcgctcccctaaggtgggtccctcagatccggggctgtccattaaccaggctggcccaaagaggcgcagacactcgaacccgggaaaacttattttattctcggttcccggggttgcagctgccagcggctgagacagtgcgtccgctttgtctctctgcactccccgcagcccccctctcccgcttcctctcccgattaactcccccgacacgctcttctctagctcctctcctcctcccactccttctcctcctcttcctcctcctacaccacaggccgcgctaatgcgcttcctccctcccccggtgtcggtctctttgcatacgcgccccctcccctccccgccgcgccacttatagcggggcgcacggcggcggggcgcagactgctctggcagccggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctgagtggaaacaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctcctggaagctggtgacatgctggagtttcaagacatccgggatgcatgtgcagagttcctggaaaagaacctgcatcccaccaactgcctgggcatgctgctgctgtctgatgcacaccagtgcaccaagctgtacgaactatcttggagaatgtgtctcagcaacttccaaaccatcaggaagaatgaagatttcctccagctgccccaggacatggtagtgcaactcttgtccagtgaagagctggagacagaggatgaaaggcttgtgtacgagtctgcaattaactggatcagctatgacctgaagaagcgctattgctacctcccagaactgttgcagacagtaaggctggcacttctgccagccatctatctcatggagaatgtggccatggaggaactcatcaccaagcagagaaagagtaaggaaattgtggaagaggccatcaggtgcaaactgaaaatcctgcagaatgacggtgtggtaaccagcctctgtgcccgacctcggaaaactggccatgccctcttccttctgggaggacagactttcatgtgtgacaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcaaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaggtgggagatgtgacagcaaagcgcatgagctgccatgctgtggcctctggaaacaaactctacgtggttggaggatactttggcattcagcgatgcaagactttggactgctacgatccaacattagacgtgtggaacagcatcaccactgtcccgtactcgctgattcctactgcatttgtcagcacctggaaacatctgccttcttaaatgcagtacattctaaagagagtgagcatgagctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagaaaagctggaccttttcccttgctgtaccatattcagcatttgatttccatgggccccaccatttatgtgtagaatttgaaatggttgtcacctctctctgaggacagagcttgaagcctccacaccagctgctgctggagattcaaagcccaactgtgggtccgagagggaagctggctgggctggctgaagaatgaagaccactggactctccgttaatctctaaggggtctgctccccaggaacgtttctgaacaatggggactttgttggtagccatttggtagatgttcttttctatttataagtgactttaaactttcccttggctgttaagaagtttgttatagatttagctatttattgttcgatgcctgcatgctgaaacaatgcctacagctgtcttcacatgtatggacgtgtgtgaatggttgtacgttttgcacattttgtggctgttgagatgtgctttgctgcacaaacatgaaaatttttgagttacaatttggagcataactggagggtgggttggggaggggtggatttttaaaatgtcaagacagggaaggatgacaaaatggaaatttaaatgacatcctagaggtagagaaaccgtggagatcgcttttctcagactcaccaacttttaatgggatttcatggggtttggttgtgctgatagggtaaggggaggctgctttctgcccttctccccactcccatctgatttacttaattcagtctcagctgctgaaatttggaaaggaccaaattgctttacagtttttttctttgtgtagtatcttgaaatcctggaaaattctatggaatagttctgtatatagggcacaagtaaaggcattgtccaaagtttatttatttatttattaccctaagaatgctttgccataaccacatttaatgggaaaaacggcagtatcacagatgtaaattaactcaccagatttactgggcctgaactcattctcttcttgctatatgatttagcaagttctagaaggtctccaagacaataattacattggcacaatgtatacttcagtgctcacccgtaggcaaatctctttttaaaaaactctttggtgcacaagtaacacatttggccacaaaacaccaaagaattgtaggcagtggcccctattgagaagttttccggtagagttggaaatcagttgtgaatacattctttgctagttggagtgcttgtttactaagcatgtgccgtcgtaggtattagtgctagtctcagataggtgcttcccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagaaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacacataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttcatta

SEQ ID NO: 324 - protein, 589 aa, Artificial Sequence
  ENC1
MSVSVHENRKSRASSGSINIYLFHKSSYADSVLTHLNLLRQQRLFTDVLLHAGNRTFPCHRAVLAACSRYFEAMFSGGLKESQDSEVNFDNSIHPEVLELLLDYAYSSRVIINEENAESLLEAGDMLEFQDIRDACAEFLEKNLHPTNCLGMLLLSDAHQCTKLYELSWRMCLSNFQTIRKNEDFLQLPQDMVVQLLSSEELETEDERLVYESAINWISYDLKKRYCYLPELLQTVRLALLPAIYLMENVAMEELITKQRKSKEIVEEAIRCKLKILQNDGVVTSLCARPRKTGHALFLLGGQTFMCDKLYLVDQKAKEIIPKADIPSPRKEFSACAIGCKVYITGGRGSENGVSKDVWVYDTLHEEWSKAAPMLVARFGHGSAELKHCLYVVGGHTAATGCLPASPSVSLKQVEHYDPTINKWTMVAPLREGVSNAAVVSAKLKLFAFGGTSVSHDKLPKVQCYDQCENRWTVPATCPQPWRYTAAAVLGNQIFIMGGDTEFSACSAYKFNSETYQWTKVGDVTAKRMSCHAVASGNKLYVVGGYFGIQRCKTLDCYDPTLDVWNSITTVPYSLIPTAFVSTWKHLPS

SEQ ID NO: 325 - DNA, 5357 bp, Artificial Sequence
  COBL
ccgcccgctagagacgattccagccccttccgtccgccgcgctccgccgctgtcctccgccggcccgcgtgggaggacgatgggtcagcgcggaaaaagtgaatgagggcggcagcggtggcggcggtagccagcgcctgactcggcgggcccggagcaccgcccgcgtcccggcccccggcaccatggacgcgccgcgcgcctcggcggccaagcccccgaccgggaggaagatgaaggctcgtgctcccccacctcctggaaaggctgccactctgcatgtgcacagtgaccagaagcccccccacgatggggccctcgggtcgcagcagaacttggttcgcatgaaggaggcgctgagggccagcaccatggacgtcaccgtggtcctgcctagtgggctggagaagaggagcgtgctcaatgggagccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaagggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatgggtggtggacggcaggtgccacaaaagcctcccagaggcactgctcggggtccaccccagttagtgcttcccccacccccgccctaccctcctcccgacacagacgtggtggagcctctcagctttcccggggaaggcgctggttccgaggcctcagacccgatacccaaactaagcctgcccctggggtctggcagccactgcagcccggatggagccccgcaggtgctgtcagaggcggaggagaccgtgtcagttggcagctgttttgcgtcggaggacacgaccgaggactcaggagtgatgagttccccctcagacatcgtctctctggactcgcagcaggacagcatgaaatacaaagacaagtgggccacagaccaggaagactgcagtgaccaggacctcgctggaaccccagacctgggtccccagaagagccccttgtgggagaagaatggctctgagaactcacatctgagaactgaaaaagctgtcacagcctcaaatgatgaagaagacctattaattgctggagagttccgtaaaacccttgcagaacttgatgaagacctggaagaaatggaagacagctatgaaacagacaccagctccctcaccagctccatccatggtgcatccaaccactgcccacaggatgccatgatccctcacggcgacacagatgcaatcccagtaacattcataggggaagtttcagatgatcctgtggattcggggttgttttccaatagaaacaacaatgctgggtctttcgactcggagggtgttgccagcaggagagactccctggcgccacttcaagctgagcacagccagccccatgaaaaggcaagggaggaagtacctgccctgcaccccgcttcccatgacgtcggaaaaggaatccgtgtggccttatctaacatctctaaagatgggaatctaatggaaacggcgcccagggtgacttcttttgcttcgaatcttcacacagacaacctaaatgcaaaagtgaaagacaaagtgtatggctgtgctgacggggagaggactcaagccacagagagagtgaattcccaaccggtgaatgaaaaggacagcaacgataaaaacgctgccttggcaccaacatcatggcaccaacgaggccaaaacccagggaaaagctacagacttaagcacggcctcacaacgtataaaatcattcctccaaagtcagagatgcgatgttacgacagagatgtgtccctctccaccggagccattaagattgacgagctggggaacttggtgagtcctcacgccaccggcatcaggatcatttccctgtcttcgtctgtgcctgaagcagaatctcagcccattgggaaagtcagagagttctggaggtgcaactctgtggaaaaacacctgggccgaccctcagagagctctgccaggggacccccctccacccctgtgcccacgcagacgcagaatccagagagcagactccaagcagaccccaagccaatatcgccccagcagaagtctgcccaccatgagggccggaaccccctaggggaggggagaaaccagccccccaccatgggcatgggtcacgtgagggtgccagcagctcacaccacagaagtcacatttctcaagcctcagagaagaacgtccagccagtatgtggcctctgccattgccaagcgcataggagccccaaaagtccatgctgatgtggtgaggccacacggttatgccgagaagggttatgcaggcaaggcgccagtgctggctgcaccacctgtcactgtgaaagatgacaggacatccagcccacactcagagacacaaggatggaaggatggtgcccagtggccctgtgtcactcctcccaacaaccacggggaagatttggcagtgggagcccctcctaggggggaggtcattggcccacacaggaagttgtctactcaggacagacctgctgctatccacagaagctcctgtttctcactggttcagtcttcccagagggatcgtgtttctgtgggacagagctgtggtttcagtggaaagcaaagcacaagtagccaggaggccagctcagcatctgagcccagacgcgcacctgatggtacagacccaccccctccacacacatctgacactcaggcctgcagcagggagctggtcaatggctctgtgcgcgccccaggccacggcgagccttcccaccctccaggagggtctggcacagaaagccacattctcctagaaagagaggaaaagcccagtgtgttctctacagatggaaatgaaacagacagtatttggccacccagcatttttgggccgaagaaaaaattcaaacctgttgtccagagaccagtcccaaaagacacatccctgcactctgccctgatggaagccatccactctgcgggagggaaggacagactacgcaagacggcagaacacaccggggagggcaggccagcgaaactgtcctacacggaggcagagggcgaacgatctgcactgctggcagctatccgcgggcacagcggcacctgcagcctgaggaaggctctctctgcaccaaggacggcctccaggttcagcacgggcaccctcagcaacaccgcagacgcaaggcaagccttgatggacgccatccgctccggcacaggggctgcgagactgagaaaggtgcccttgctcgtgtgaatgaacagaggccagagaattgcagaaacccacctgtaatatgcccacaggcgtcactcaaggagtctgcatagccaggaacatcaagttttggtgttactttcttgtctacaggccaaatgcgcacagttgattttcggtgtgttcctgtataacggcttgaaaggaaaggagaagatgctgtgtcgctgcgcagctcgtgtgccaaggaaatgtgttttgcctctgaatatcttaagttgctaataaacgattcttgttggcaggttaatgggactataaatgctggagcccagcactcacacttaattatatttatgggcaaagtaaaaagaatcatgccttagactgattttggacctttgagacttttaccacatacagatggatgaaactacttactgatttaagatcttttgaattttagaaaaaacatatgaatcagatggaacaatctgaatgtgatatgctccatgatgctgtgtgttttggtagtaagaaaaaaaaattgggaggcttttcaaaggtggctttgttaggtagtaaaactgctggattcttcttcctcaaatatttggggctaacacttcacagagggtcacagtccatgatctgaccaactaagcttttaaaaatcaactattaccacccagaaaacagtcctacgtgatcatgtggccagggcatgcccgagtcctgcaagggtggcgggtggctgaggtcacaccaccactggagtggatgggcagtgccccacatggacagccattccccaggctatgaagtgacataggcctcccccacggtgcctgtgtacggagcctgatgacttcactgggagccttctggaatcctgcagagggtcaaggagcagggatgttggatgcccacctgtcaagagttcagatcaaagttgcgctgagagcatcacaattttggttcagccttgacgcgtttgtccaacagctcattggctccctttgtatgatatcgtggtcttctcacatggtgcccagtcaccaatatttataatgaggtctaactacagcagtagtttttcatatatatctctaaaacattttgttatattgaaaaaagtaatagaaatcaagatgtgttgatgaaataaaatgtgtatctgagtgagaaaacaagtatggtgaggtcactttaatgtttcacagcgatctcagatctaggcctcaggtagaatggaagctgttctgcattcactgattaacgttgctaaactcttggtgaggcacgagctaccagccaattgctcttcatcacagctatctgtcttttagtgccacaaataaaagaaaatcaaatcttaaaaaaaaaaaaaaaaaa

SEQ ID NO: 326 - protein, 1271 aa, Artificial Sequence
  COBL
MDAPRASAAKPPTGRKMKARAPPPPGKAATLHVHSDQKPPHDGALGSQQNLVRMKEALRASTMDVTVVLPSGLEKRSVLNGSHAMMDLLVELCLQNHLNPSHHALEIRSSETQQPLSFKPNTLIGTLNVHTVFLKEKVPEEKVKPGPPKVPEKSVRLVVNYLRTQKAVVRVSPEVPLQNILPVICAKCEVSPEHVVLLRDNIAGEELELSKSLNELGIKELYAWDNRRETFRKSSLGNDETDKEKKKFLGFFKVNKRSNSKGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMGGGRQVPQKPPRGTARGPPQLVLPPPPPYPPPDTDVVEPLSFPGEGAGSEASDPIPKLSLPLGSGSHCSPDGAPQVLSEAEETVSVGSCFASEDTTEDSGVMSSPSDIVSLDSQQDSMKYKDKWATDQEDCSDQDLAGTPDLGPQKSPLWEKNGSENSHLRTEKAVTASNDEEDLLIAGEFRKTLAELDEDLEEMEDSYETDTSSLTSSIHGASNHCPQDAMIPHGDTDAIPVTFIGEVSDDPVDSGLFSNRNNNAGSFDSEGVASRRDSLAPLQAEHSQPHEKAREEVPALHPASHDVGKGIRVALSNISKDGNLMETAPRVTSFASNLHTDNLNAKVKDKVYGCADGERTQATERVNSQPVNEKDSNDKNAALAPTSWHQRGQNPGKSYRLKHGLTTYKIIPPKSEMRCYDRDVSLSTGAIKIDELGNLVSPHATGIRIISLSSSVPEAESQPIGKVREFWRCNSVEKHLGRPSESSARGPPSTPVPTQTQNPESRLQADPKPISPQQKSAHHEGRNPLGEGRNQPPTMGMGHVRVPAAHTTEVTFLKPQRRTSSQYVASAIAKRIGAPKVHADVVRPHGYAEKGYAGKAPVLAAPPVTVKDDRTSSPHSETQGWKDGAQWPCVTPPNNHGEDLAVGAPPRGEVIGPHRKLSTQDRPAAIHRSSCFSLVQSSQRDRVSVGQSCGFSGKQSTSSQEASSASEPRRAPDGTDPPPPHTSDTQACSRELVNGSVRAPGHGEPSHPPGGSGTESHILLEREEKPSVFSTDGNETDSIWPPSIFGPKKKFKPVVQRPVPKDTSLHSALMEAIHSAGGKDRLRKTAEHTGEGRPAKLSYTEAEGERSALLAAIRGHSGTCSLRKALSAPRTASRFSTGTLSNTADARQALMDAIRSGTGAARLRKVPLLV

SEQ ID NO: 327 - DNA, 2022 bp, Artificial Sequence
  EEF1A2
gccccgcccccgcccgcggcgcgtttctcccccgcctcccgcgtccgtctttgcagcccgcgcctcccgcatcgcctcgcgtccccgtggcgcccgcccgcgcgcgtccgcgccccgccccctcccgcgcggttccgcattggcgtgctgcagggcgcggtgcactgcgccgccaccgtcaataggtggaccccctcccggagataaaaccgccggcgccggcgccgccagtccctctggctgagacctcggctccggaatcactgcagcccccctcgccctgagccagagcaccccgggtcccgccagcccctcacactcccagcaaaatgggcaaggagaagacccacatcaacatcgtggtcatcggccacgtggactccggaaagtccaccaccacgggccacctcatctacaaatgcggaggtattgacaaaaggaccattgagaagttcgagaaggaggcggctgagatggggaagggatccttcaagtatgcctgggtgctggacaagctgaaggcggagcgtgagcgcggcatcaccatcgacatctccctctggaagttcgagaccaccaagtactacatcaccatcatcgatgcccccggccaccgcgacttcatcaagaacatgatcacgggtacatcccaggcggactgcgcagtgctgatcgtggcggcgggcgtgggcgagttcgaggcgggcatctccaagaatgggcagacgcgggagcatgccctgctggcctacacgctgggtgtgaagcagctcatcgtgggcgtgaacaaaatggactccacagagccggcctacagcgagaagcgctacgacgagatcgtcaaggaagtcagcgcctacatcaagaagatcggctacaacccggccaccgtgccctttgtgcccatctccggctggcacggtgacaacatgctggagccctcccccaacatgccgtggttcaagggctggaaggtggagcgtaaggagggcaacgcaagcggcgtgtccctgctggaggccctggacaccatcctgccccccacgcgccccacggacaagcccctgcgcctgccgctgcaggacgtgtacaagattggcggcattggcacggtgcccgtgggccgggtggagaccggcatcctgcggccgggcatggtggtgacctttgcgccagtgaacatcaccactgaggtgaagtcagtggagatgcaccacgaggctctgagcgaagctctgcccggcgacaacgtcggcttcaatgtgaagaacgtgtcggtgaaggacatccggcggggcaacgtgtgtggggacagcaagtctgacccgccgcaggaggctgctcagttcacctcccaggtcatcatcctgaaccacccggggcagattagcgccggctactccccggtcatcgactgccacacagcccacatcgcctgcaagtttgcggagctgaaggagaagattgaccggcgctctggcaagaagctggaggacaaccccaagtccctgaagtctggagacgcggccatcgtggagatggtgccgggaaagcccatgtgtgtggagagcttctcccagtacccgcctctcggccgcttcgccgtgcgcgacatgaggcagacggtggccgtaggcgtcatcaagaacgtggagaagaagagcggcggcgccggcaaggtcaccaagtcggcgcagaaggcgcagaaggcgggcaagtgaagcgcgggcgcccgcggcgcgaccctccccggcggcgccgcgctccgaaccccggcccggcccccgccccgcccccgccccgcgcgccgctccggcgccccgcacccccgccaggcgcatgtctgcacctccgcttgccagaggccctcggtcagcgactggatgctcgccatcaaggtccagtggaagttcttcaagaggaaaggcgcccccgccccaggcttccgcgcccagcgctcgccacgctcagtgcccgttttaccaataaactgagcgaccccagaaaaaaaaaaaaaaaaaa

SEQ ID NO: 328 - protein, 463 aa, Artificial Sequence
  EEF1A2
MGKEKTHINIVVIGHVDSGKSTTTGHLIYKCGGIDKRTIEKFEKEAAEMGKGSFKYAWVLDKLKAERERGITIDISLWKFETTKYYITIIDAPGHRDFIKNMITGTSQADCAVLIVAAGVGEFEAGISKNGQTREHALLAYTLGVKQLIVGVNKMDSTEPAYSEKRYDEIVKEVSAYIKKIGYNPATVPFVPISGWHGDNMLEPSPNMPWFKGWKVERKEGNASGVSLLEALDTILPPTRPTDKPLRLPLQDVYKIGGIGTVPVGRVETGILRPGMVVTFAPVNITTEVKSVEMHHEALSEALPGDNVGFNVKNVSVKDIRRGNVCGDSKSDPPQEAAQFTSQVIILNHPGQISAGYSPVIDCHTAHIACKFAELKEKIDRRSGKKLEDNPKSLKSGDAAIVEMVPGKPMCVESFSQYPPLGRFAVRDMRQTVAVGVIKNVEKKSGGAGKVTKSAQKAQKAGK

SEQ ID NO: 329 - DNA, 2022 bp, Artificial Sequence; identical to SEQ ID NO: 327
  KBTBD11

SEQ ID NO: 330 - protein, 463 aa, Artificial Sequence; identical to SEQ ID NO: 328
  KBTBD11

SEQ ID NO: 331 - DNA, 5158 bp, Artificial Sequence
  RGL1
gtgattctcggtgggggggttcccatagaaacgcttttctgcggtccagtctagggggtctcagattggcggggatgggcagcagcggcaggtggccttggcttttgctgcagccgtcaacgacctatcatcggggtcctgcgtaaggtccggctggctgggacttggctgtgggtgggatggactggctgccggaccgagtgccctgcagttggtaggagtatgaggcagagtgatgcacacccgggcgcccagcatcgttctaattgccggagacattgcctcagactgtgcgctgctagaggctgcgttcctgagcaggaagcccgtttcctgggattggaactacccttcttggccagcgggaagtccccaaggacggagtcgaaaggtcaaatcttatctgtcagtgctgtgtgacagcatcgcaacgggatctgcagaacctgaactcgatccgtaatgcctcctgcctgcctctttcaagatggaggtgaaacctgtgggagaacctactcaagaggtgtctaaattcaaactttccaccaaggtagaaagcacgggacactggctggtggaagatcatgttcgaatatgggaagttttaaagacagaggagagctcgattcaggactggggtgaagaggtagaggaaggagctgtttaccatgtcaccctcaaaagagtccagattcaacaggctgccaataaaggagcaagatggctaggggttgaaggggaccagctgcctccaggacacacagtcagtcaatatgaaacctgtaagatcaggaccataaaagctggcaccttggagaagcttgtggagaacctgctgacagcttttggggacaatgactttacctatatcagcatctttctttcaacgtacagaggctttgcctccactaaagaagtgctggaactactgctggacaggtatggaaacctgacaagcccaaactgtgaagaagatggaagccaaagttcatcagagtccaaaatggtgatcaggaatgcaatcgcttccatactaagggcctggcttgaccagtgtgcagaagacttccgagagccccctcacttcccttgcttacagaaactgctggattatctcacacggatgatgccgggctctgacccagaaagaagagcacaaaatcttcttgagcagtttcagaagcaagaagtggaaactgacaatgggcttcccaacacgatctccttcagcctggaagaggaagaggaactggagggtggagagtcagcagaattcacgtgcttctcagaagatctcgtggcagagcagctgacctacatggatgcacaactcttcaagaaagtagtgcctcaccactgcctgggctgcatttggtctcgaagggataagaaggaaaacaaacatttggctcctacgatccgtgccaccatctctcagtttaataccctcaccaaatgtgttgtcagcaccatcctggggggcaaagaactcaaaactcagcagagagccaaaatcattgagaagtggatcaacatcgctcatgaatgtagactcctgaagaatttttcctccttgagggccatcgtttcggcactgcagtctaattccatctatcggttaaaaaagacttgggctgccgtcccaagggaccgaatgctgatgtttgaagaactttcagatatcttctcagaccataataaccatttgaccagccgagaactactgatgaaggaaggaacctcaaaatttgcaaacctggacagcagtgtgaaagaaaaccagaagcgtacccagaggcggctgcagctccagaaggacatgggtgtgatgcagggaactgtgccctacctgggcaccttcctgactgacctgaccatgcttgacactgcccttcaggactacatcgagggtggactgataaactttgagaaaaggagaagggaatttgaagtgattgcccagataaagctcttacagtctgcctgcaacagctattgcatgaccccagaccaaaagttcatccagtggttccagaggcagcagctcctgacagaggaggagagctatgccctgtcatgtgagattgaagcagctgctgacgccagcaccacctcgcccaagcctcggaagagcatggtgaagagactcagcctactgtttctagggtctgacatgatcaccagtcccactcccaccaaagagcagcccaagtccactgccagcgggagctctggtgaaagcatggactctgtcagcgtgtcatcctgcgagtcgaaccactcagaggctgaggagggctccattactcccatggacacccctgatgagcctcaaaaaaagctctctgagtcctcctcatcctgttcttctatccattccatggacacaaattcctcagggatgtcttccttaatcaaccccctctcctcccctccgtcctgcaacaacaaccccaaaatccacaagcgctctgtctcggtgacgtccattacctcgactgtgctgcctcctgtttacaaccaacagaatgaagacacctgcataatccgcatcagtgtggaagacaataacggcaacatgtacaagagcatcatgttgacgagccaggataaaacccccgctgtgatccagagagccatgctgaagcacaatctggactcagaccccgccgaggagtacgagctggtgcaggtcatctcggaggacaaagaacttgtgattccagactcagcaaatgtcttttatgccatgaacagccaagtgaactttgacttcattttgcgcaaaaagaactccatggaagaacaagtgaaactgcgtagccggaccagcttgacgttgcccaggacagctaaacggggctgctggagtaacagacacagcaaaatcaccctctgaagggagggaccagtggccccttgtttgccaaaggcagagtggggctgagaaacaggctgcggtgattgcaattaccatccggtgttcgaggatcattggtgaagtcagcagatatttattgagttcctgtggtgtgcaaagcattatgataggcaccgtggggaaactggaaatgaatttgacatgaaaaggatgaacgattcactgattctctttgactcatttgagactaaaatgcagaattaccaacatttaaaacatatatatgcacatgtatttggtatgcatgtgtatctatataaaaatatataagagggactttatgggatagtatggactatggaaaaacaaatttgcacaatggcctgggaagttgaggtcactttttacagggaaatagaagaaactgagaacctagtctcgtatattctgagtaaatggaatcagtcctgggaatagagagtgtcctttgtgccagtattacaagaagcccaaactttatttttataaagggagaggatgactttctcaatcaagtgccaccagataaaaacaactgcagaggctggaactgccacaggctgtatgaaaggccactttggaaagggtttggatgagctggtggccttcaacctctgcctgcatctgccactttctgctaccctagggaggccaggaggagcttcggaggaccatcgccccactggtctagccatcatgacacctctggaggtgtcaagctcctgaaacaagctcatttcagtttctggcaaccccgtgtatttccgttttccccctaaagaacatatcataatcattgcacaaataaccatgttctttggtaatgaagccagaaaagaaagcgcaaaagaatggtgactcatttggactcttatctgtcttggaatgtcactgcttcattgccttctctgattgccttttgcatgtaaaactatgtgtctggagtcttttgccatctggatcttagtacctctttattatgtgcaatttattcctcaggtgtggaaatttctactgcaattgactacgtttgattattttgagcttgtgaaagatttctgaacagtgattgtcccgttaatagcccctcagaagatgttccctgctgataacagcatcctattttacttacttttatagcattactgtgcctagtcgtggggaaagagatggggctgtatagattatctgaatcatttgtctaagaggtacattcttccagatggaatcaataacttttttttttccaggttcccgtgcttgctatcacagtatcattgttaagtgacacttttgtctctcataacaccatcacactcttccttccaagtctgagctgtgctggggtttgaactaaaagccatatgtggaatattgacatgtgtaagaagcactttcagaatgttgtcctttttaagaaatgattctcaaaataccagtttttattccaaaaatttagagaacaaacccggaatatgaagtgcagattgtaacatggagctatttttttttcttaatcccataatacagctcctaaaagttgtgtgggatttgcgttgcataaatagccatgtgaattccacaagaagcaccagggaaagtttagagatttgcggcaatggaccgaagaacgggccaggaagtcctccaatttcctttggtctttccaggagattggactacacattgtaaagactgactgggtttcaactagtcaaaaagcactttcttctgttttcaatccctgttcgatttgtgcttctgtgcttgtaggagagatggccagggtggcagccctcatgcaggttgaagtatatgtagcctcagcctgatattcttggtgcgaaggtaaaaaaaaaaaaataaataaaaccattggcctggttgagggcgtgaccaccaagacatatatgttgtgcccgtgttcatcctgtgtatttatactgtatatgtagagtctagatttatatactgcaatgtaaaatatatatatatttaccttttttaaagacaatggaaattccaagtagctaaaacttagcttcatttatttaatgccactttaaatgtcttaaatttgtttcctggtggacagccgggtaatgcttttagctgctcgcatgcttgtctttctgcatctccatcatctgtttaccttttggttaaactaataaactagtttgggacttggctggcatgtgctgccagacccaaagggattgtatctggattattaac

SEQ ID NO: 332 - protein, 803 aa, Artificial Sequence
  RGL1
MEVKPVGEPTQEVSKFKLSTKVESTGHWLVEDHVRIWEVLKTEESSIQDWGEEVEEGAVYHVTLKRVQIQQAANKGARWLGVEGDQLPPGHTVSQYETCKIRTIKAGTLEKLVENLLTAFGDNDFTYISIFLSTYRGFASTKEVLELLLDRYGNLTSPNCEEDGSQSSSESKMVIRNAIASILRAWLDQCAEDFREPPHFPCLQKLLDYLTRMMPGSDPERRAQNLLEQFQKQEVETDNGLPNTISFSLEEEEELEGGESAEFTCFSEDLVAEQLTYMDAQLFKKVVPHHCLGCIWSRRDKKENKHLAPTIRATISQFNTLTKCVVSTILGGKELKTQQRAKIIEKWINIAHECRLLKNFSSLRAIVSALQSNSIYRLKKTWAAVPRDRMLMFEELSDIFSDHNNHLTSRELLMKEGTSKFANLDSSVKENQKRTQRRLQLQKDMGVMQGTVPYLGTFLTDLTMLDTALQDYIEGGLINFEKRRREFEVIAQIKLLQSACNSYCMTPDQKFIQWFQRQQLLTEEESYALSCEIEAAADASTTSPKPRKSMVKRLSLLFLGSDMITSPTPTKEQPKSTASGSSGESMDSVSVSSCESNHSEAEEGSITPMDTPDEPQKKLSESSSSCSSIHSMDTNSSGMSSLINPLSSPPSCNNNPKIHKRSVSVTSITSTVLPPVYNQQNEDTCIIRISVEDNNGNMYKSIMLTSQDKTPAVIQRAMLKHNLDSDPAEEYELVQVISEDKELVIPDSANVFYAMNSQVNFDFILRKKNSMEEQVKLRSRTSLTLPRTAKRGCWSNRHSKITL

SEQ ID NO: 333 - DNA, 1870 bp, Artificial Sequence
  CA11
atcccaccccaagccaacccgaggagtgtttgccgctatgagatcacctgctcccccagcccaacaacaaaattaaataacaccacgggagaggagagagggagggggaggagggaggaagggacaagagagaagagagactgaaacagggagaagaggcaggagaggaggaggtggggagagcacgaagctggaggccgacactgagggagggcgggaggaggtgaagaaggagagaggggagaagaggcaggagctggaaaggagagagggaggaggaggaggagatgcgggatggagacctggagttaggtggcttgggagagcttaatgaaaagagaacggagaggaggtgtgggttaggaaccaagaggtagccctgggggcagcagaaggctgagaggagtaggaagatcaggagctagagggagactggagggttccgggaaaagagcagaggaaagaggaaagacacagagagacgggagagagaagaagagtgggtttgaagggcggatctcagtccctggctgctttggcatttggggaactgggactccctgtggggaggagaggaaagctggaagtcctggagggacagggtcccagaaggaggggacagaggagctgagagaggggggcagggcgttgggcaggggtccctcggaggcctcctggggatgggggctgcagctcgtctgagcgcccctcgagcgctggtactctgggctgcactgggggcagcagctcacatcggaccagcacctgaccccgaggactggtggagctacaaggataatctccagggaaacttcgtgccagggcctcctttctggggcctggtgaatgcagcgtggagtctgtgtgctgtggggaagcggcagagccccgtggatgtggagctgaagagggttctttatgacccctttctgcccccattaaggctcagcactggaggagagaagctccggggaaccttgtacaacaccggccgacatgtctccttcctgcctgcaccccgacctgtggtcaatgtgtctggaggtcccctcctttacagccaccgactcagtgaactgcggctgctgtttggagctcgcgacggagccggctcggaacatcagatcaaccaccagggcttctctgctgaggtgcagctcattcacttcaaccaggaactctacgggaatttcagcgctgcctcccgcggccccaatggcctggccattctcagcctctttgtcaacgttgccagtacctctaacccattcctcagtcgcctccttaaccgcgacaccatcactcgcatctcctacaagaatgatgcctactttcttcaagacctgagcctggagctcctgttccctgaatccttcggcttcatcacctatcagggctctctcagcaccccgccctgctccgagactgtcacctggatcctcattgaccgggccctcaatatcacctcccttcagatgcactccctgagactcctgagccagaatcctccatctcagatcttccagagcctcagcggtaacagccggcccctgcagcccttggcccacagggcactgaggggcaacagggacccccggcaccccgagaggcgctgccgaggccccaactaccgcctgcatgtggatggtgtcccccatggtcgctgagactccccttcgaggattgcacccgcccgtcctaagcctccccacaaggcgaggggagttacccctaaaacaaagctattaaagggacagaatacttcctgttttctcagtggtctgattctaggcgcggtggggaaacatttgggtattaaagaacagacttcttccggaaaccaaaaaaaaaaaaaaaaaaaaaaaaaaaa

SEQ ID NO: 334 - protein, 328 aa, Artificial Sequence
  CA11
MGAAARLSAPRALVLWAALGAAAHIGPAPDPEDWWSYKDNLQGNFVPGPPFWGLVNAAWSLCAVGKRQSPVDVELKRVLYDPFLPPLRLSTGGEKLRGTLYNTGRHVSFLPAPRPVVNVSGGPLLYSHRLSELRLLFGARDGAGSEHQINHQGFSAEVQLIHFNQELYGNFSAASRGPNGLAILSLFVNVASTSNPFLSRLLNRDTITRISYKNDAYFLQDLSLELLFPESFGFITYQGSLSTPPCSETVTWILIDRALNITSLQMHSLRLLSQNPPSQIFQSLSGNSRPLQPLAHRALRGNRDPRHPERRCRGPNYRLHVDGVPHGR

SEQ ID NO: 335 - DNA, 3692 bp, Artificial Sequence
  NETO2
gcacatgcgcacaggcggcgcagccggcacgcggcgctcgcgctccctccttaaatgagcctgggcgccccgcgcccgccacttcagtggatcccgcgccggggccgcgggcggagctgcctgccggtcccgcgccgcgcgtccgcactcctcggccctcgggcggtcgatgggacggggcgccgcggagcaggaggcggcgcccgtcggggtgctcgggccgcgcgggagcccactgtggggctcgggcatggcgggccgcaggacctgagctctcctcaggggagcggggaggcagctgctggccggcgatggggacggagtggggccgtcgccgccgcgccgagccgtgagcgccgagccaccgccgccgctacctcagcccttcgcgaagcgccgggcagctcgggaacatggccctggagcggctctgctcggtcctcaaagtgttgttaataacagtactggtagtggaagggattgccgtggcccaaaaaacccaagatggacaaaatattggaatcaagcatattcctgcaacccagtgtggcatttgggttcgaaccagcaatggaggtcattttgcttcgccaaattatcctgactcatatccaccaaacaaggagtgtatctacattttggaagctgctccacgtcaaagaatagagttgacctttgatgaacattattatatagaaccatcatttgagtgtcggtttgatcacttggaagttcgagatgggccatttggtttctctcctcttatagatcgttactgtggcgtgaaaagccctccattaattagatcaacagggagattcatgtggattaagtttagttctgatgaagagcttgaaggactgggatttcgagcaaaatattcatttattccagatccagactttacttacctaggaggtattttaaatcccattccagattgtcagttcgagctctcgggagctgatggaatagtgcgctctagtcaggtagaacaagaggagaaaacaaaaccaggccaagccgttgattgcatctggaccattaaagccactccaaaagctaagatttatttgaggttcctagattatcaaatggagcactcaaatgaatgcaagagaaacttcgttgcagtctatgatggaagcagttctattgaaaacctgaaggccaagttttgcagcactgtggccaatgatgtaatgcttaaaacaggaattggagtgattcgaatgtgggcagatgaaggtagtcggcttagcaggtttcgaatgctctttacttcctttgtggagcctccctgcacaagcagcactttcttttgccatagcaacatgtgcatcaataattctttagtctgtaatggtgtccaaaattgtgcatacccttgggatgaaaatcattgtaaagaaaagaaaaaagcaggagtatttgaacaaatcactaagactcatggaacaattattggcattacttcagggattgtcttggtccttctcattatttctattttagtacaagtgaaacagcctcgaaaaaaggtcatggcttgcaaaaccgcttttaataaaaccgggttccaagaagtgtttgatcctcctcattatgaactgttttcactaagggacaaagagatttctgcagacctggcagacttgtcggaagaattggacaactaccagaagatgcggcgctcctccaccgcctcccgctgcatccacgaccaccactgtgggtcgcaggcctccagcgtcaaacaaagcaggaccaacctcagttccatggaacttcctttccgaaatgactttgcacaaccacagccaatgaaaacatttaatagcaccttcaagaaaagtagttacactttcaaacagggacatgagtgccctgagcaggccctggaagaccgagtaatggaggagattccctgtgaaatttatgtcagggggcgagaagattctgcacaagcatccatatccattgacttctaatcttctgctaatggtgatgtgaattcttagggtgtgtacgtacgcagcctccagggcaccatactgtttccagcagccaacccttttctcccatcacaactacgaagaccttgatttaccgttaacctattgtatggtgatgtttttattctctcaggcagtctatatatgttaaaccaatcaaggaacttactctattcagtggaaacaataatcatctctattgcttggtgtcatttataggaagcactgccagttaaagagcattagaagaggtggttggatggagccaggctcaggctgcctcttcgttttagcaacaagaagactgctcttgactgataacagctctgtcaatattttgatgccacaataaacttgatttttctttacattccttttatttttcctttctctaaatttaatttgttttataagcctatcgttttaccatttcattttcttacataagtacaagtggttaatgtaccacatacttcagtataggcatttgttcttgagtgtgtcaaaatacagctagttactgtgccaattaagacccagttgtatttcacccatctgtttcttcttggctaatctctgtacttctgccttttaattactgggcccttattccttattttctgtgagaaataatagatgatatgatttattacctttcaattatatttttctcagttatactagaaaatttcataatcctgggatatatgtaccattgtcagctatgactaaaaatttgaaaaagataaaaatttctagcaagcctttgaagtttaccaagtatagtcacattcagtgacagcccattcattccagtaaagaatcatttcattcactttgggagaggcctataattacatttatttgcaatgtttctcttcgctagattgttacatagctcccattctgttggttttgcttacagcatatggtaaccaaggttagatgccagttaaaattccttagaaattggatgagccttgagattgcttcttaactgggacatgacatttttctagctcttatcaagaataacaacttccacttttttttaaactgcacttttgactttttttatggtataaaaacaataatttataaacataaaagctcattgtgttttttagacttttgatattatttgatactgtacaaactttattaaatcaagatgaaagacctacaggacagattcctttcagtgttcacatcagtggctttgtatgcaaatatgctgtgttggacctggacgctataacttattgtaaagaccttggaaatgtggacataagctctttctttccttttgttactgtatttagtttgtgataaatttttcactgtgtgatatttatgctctaaatcactacacaaatcccatattaaaatatacattgtacctgaccctttaatcatgttatttatgccaccaaggttgtggatcttaaggtatgtatggaaaggaactcatttatcaaattgtaagtaatacagacatgccatttaaaagaggtaaattcttgttttctatattttgttagtaaattctcaatgaaataagttgaagtttcactggatttcattaacttttaaatattacatatatgtgttttctcagattagtgaaaattgtgaccttaaatttaatacacatatactgcctcagagtgctttctt

SEQ ID NO: 336 - protein, 525 aa, Artificial Sequence
  NETO2
MALERLCSVLKVLLITVLVVEGIAVAQKTQDGQNIGIKHIPATQCGIWVRTSNGGHFASPNYPDSYPPNKECIYILEAAPRQRIELTFDEHYYIEPSFECRFDHLEVRDGPFGFSPLIDRYCGVKSPPLIRSTGRFMWIKFSSDEELEGLGFRAKYSFIPDPDFTYLGGILNPIPDCQFELSGADGIVRSSQVEQEEKTKPGQAVDCIWTIKATPKAKIYLRFLDYQMEHSNECKRNFVAVYDGSSSIENLKAKFCSTVANDVMLKTGIGVIRMWADEGSRLSRFRMLFTSFVEPPCTSSTFFCHSNMCINNSLVCNGVQNCAYPWDENHCKEKKKAGVFEQITKTHGTIIGITSGIVLVLLIISILVQVKQPRKKVMACKTAFNKTGFQEVFDPPHYELFSLRDKEISADLADLSEELDNYQKMRRSSTASRCIHDHHCGSQASSVKQSRTNLSSMELPFRNDFAQPQPMKTFNSTFKKSSYTFKQGHECPEQALEDRVMEEIPCEIYVRGREDSAQASISIDF

SEQ ID NO: 337 - DNA, 2118 bp, Artificial Sequence
  DOK5
gcgttccagggcggctgctcacgggtggccgcagcccagtgctgggactcgcgcggctcctcctcttagccccccaccccttcctcctctttcctcctcctccttcctcctcctcctcctccttcttctcctccttctcggccgggaggaggcagggctggatccctcagccgccgccgctcctcctcctggcaggccggccgcggagtcagctgacgccggcgctccagcctcgcctccccgcgccgcgctctgcgctccccgaaagtggctgcaagccggccgcccactgtcagggttggggggacagagaaagtgatgtgcgccttctaaagcctcgcccagcgccgccgaagcagcttcacctctccaactttctcccaccgactgcttgtcttgaccctgccctccaccctccccagagccacttcgggtgcgcgctcttgggtaaagggggggtcaccggctgtctgggatggcttccaattttaatgacatagtgaagcaagggtacgtgaggatccggagcagacgcctcgggatttatcagcgatgctggttagtattcaagaaagcttcaagcaaaggtccaaaaagactggagaaattttctgatgaacgtgctgcatatttcaggtgttatcataaggttacagaactcaataatgtgaagaacgtagctcgattgccaaaaagcaccaagaaacatgccatagggatttatttcaatgacgatacctccaagacttttgcttgcgaatcagatcttgaggctgatgagtggtgcaaagtactccagatggagtgtgtaggaacacggatcaatgacatcagccttggagagcctgacttactggccactggggttgagagagaacagagtgagagattcaatgtgtatttgatgccatctcctaacttagatgtacatggcgaatgtgccttgcagattacatatgagtatatctgtctttgggacgtccagaatcccagagtcaaactcatctcttggccgctaagcgccctgcggcggtatggacgtgatactacgtggttcacttttgaggcagggaggatgtgtgagactggtgaagggctgtttatctttcagacccgagacggggaggccatctatcagaaagtccactctgctgccttggccatagccgagcagcacgagcgcttgctacagagtgtgaaaaactcgatgctccagatgaagatgagtgagcgggccgcctcgctgagcaccatggtgcccctgcctcgcagcgcctactggcagcacatcacacggcagcacagcacgggacagctctaccgcttgcaagatgtttccagccctctgaagcttcatcgaacagagacttttccagcctacagatctgagcactgacagtaactgccaagaattgttaacacacttgtgatgtgtcagccacagattcacccaggaggtcacagaatgacagcaagggaaatgacgaccaagagaagaagcttaaagtcctggctaattgtgtggtcattggaaaactctgcaatacaataattttctttattttctttttcttttttaaattcttagtgtaattgaaacgtgctctatagatattgactctgtgttccctcttttacagctggacagaaagaagtcaatgtcacgaaatgattttctattgtagatactttgtcccttgcacttctctgaatctgtccttttgtggattcttgtgattttccttccaagtgtttcagttgtatgacagtcagtattgacaataaaatggcttttaattatttgttatttgtttacaccctattcctcagttattattactgtggttctgattaactactggaaattatatttgattatatcaccaattagttaaatcagtgcttcgactcactcttatctgttctgttcaaaactatttgttcaaagaacccgttagtgttgtttacagggttacagtttctctcacatgctttcctcacccctttacccccctttttgaaagcctttattttgttcggagtctcttcataaaacatttgaaaataaaagatcattcttcacccataaaaaaaaaaaaaaaaaaaaaaaaaaaaaaa

SEQ ID NO: 338 - protein, 306 aa, Artificial Sequence [sequence omitted]

SEQ ID NO: 339 - DNA, 2019 bp, Artificial Sequence
  TUBB2B
gggggctcgggctgggggcgcggcctgtgccggccgccccaccctccttgcataaaagccggagcccgcggggccggcgctctcagcccgtcggttcccgagcgccttcccggtgaccccgcagtgggtgtgtgaggggaggacggacagacccagacgccgccggaccaggaggacgctgacgaggcaccatgcgtgagatcgtgcacatccaggcgggccagtgcggcaaccagatcggcgccaagttttgggaggtcatcagtgatgagcatgggattgaccccactggcagttaccatggagacagtgatttgcagctggagagaatcaatgtttactacaatgaagccactggtaacaaatatgttcctcgggccatcctcgtggatctggagccaggcacgatggattcggttaggtctggaccattcggccagatcttcagaccagacaatttcgtgtttggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcgtagatgcccccgcgagacgggttagggaaagcggaggaggaaagcgagggggtggggggcttcccgggacgataacctggcagtggaaggaaagaagcatggtctactttaggtgtgcgctgggtctctggtgctcttcactgttgcctgtcactttttttttccttttttgtaatattgatgacatcaatgtaacatttgagatatttctgaattactgttgtaatggctaaaatcacataaacgtttgtgtcggaatggtgtcctctctttctcttcctttttctctttattaacgatttaaatgtaactttctgaacacattgcattgaattcttcctttaacaaaaagcaaaggcgtaggtaaaagctcaaatgaatttattctttcggtatggtaaaattgaaccaatcacagttaagatgagagatcaacctgagttttaaaatacctttaataaatattagttgaaaaaatgtctacttgaaagca

SEQ ID NO: 340 - protein, 445 aa, Artificial Sequence [sequence omitted]

SEQ ID NO: 341 - DNA, 9632 bp, Artificial Sequence
  PCDH19
agtagtttgcggcatccggaggagcagcagcagcagtagcggcggcggctggcgcagcgcggagacggacgagcgggcacagacggcagcacagctcccgtgcaccatgcctggcttgcccgggaggcactggcacccgcgtccctagcccggcgctggcccttggcgcgttgcgctccgcagcattccggctgagcgatttcatccgaaatcctaaacctcctaccccaaacccattgcctcctgcttgctcatactccacactcacactccccacaccacacactcactcttcctctctctctcacacattcacacacagcccgagacagacagagaaagcgagacagacctcccgagtgcgcgagcgcccgggaggaagggagcccaacgcagcgcggccagcgcctctccgggaagatgaaatcaagacgctcctgcaagtaaacttcggcggcgacaaaatcgtcgactgtggcagctgctgaggcggaccccagcgacgtgcaactgagctaggagggcttcctcccgcggcggcggcggcggcggcggcggcggcggaccttggagcgacaccccagcccaaacggagagaagagaagcacccggtacccacggcggcggccccgcctctcctggccggtactgttgttgcctccccttccctcttccccattccccgccacccccggccattagaaagaccggggctttgattttcttggacaaattgccatctccccgtttccacaaacttgacgtggagggtcggactgcgttgttaactttgatttcctagacgaaaacgcccgcagaccctcaactgctctgtggggggaactccgctcccacctcggatcctggacagacgcgcccccaagcccttcgaagccagccttagcgcgagggagcgcgctcaagctctggcagcctctctcccctcccccttcctctgctggccccgggaccgccatccgactcaaccctataaccgggtgcccgcggcgcttgccagtaactgactcccgtctgcgacaccccctttctcccgaacaggcctcgaagaggccagtgtggcccccccagaccccggagggcgcattccaagcgggtactctctccgcagtgaactgggagcgctggggggaggtctttgcgcatgccaggtgcacagacagcgagttcgccagcctcagtgccggtgcaccgcggcgggccgggcagtgcctgaaaggctgcgcctcctccgccctctttaccttcgcctcaagtactgtccggactcagcggtgcgtcctccaggccgcgcagacgccgcccgacccgcagccctgggcggctgccgacagtcgcgcccggctaactttgaaggggtaaaactgagtagccgggctggagggagggggctcggggccgcgcggcgctcccttggcccctcggagcccccggggcccccgcgagcccccgccgcgtccgccgcaacctcagcattggagccgccgcgggtgtcccccgcgcgccgccgggccgccctgggcgggacttctcccgcggcctccggggccacggggcgcgcgcaacaggcggcccgagccggcgggaagctggagcgccgacggcgtcggtctcggaggggtgtggagaggcgaggccaggcagagccccgtgcagccatggagtcgctcctgctgccggtgctgctgctgctggccatactgtggacgcaggctgccgccctcattaatctcaagtactcggtagaagaggagcagcgcgccgggacggtgattgccaacgtggccaaagacgcgcgagaggcgggcttcgcgctggacccccggcaggcttcagcctttcgcgtggtgtccaactcggctccacacctagtggacatcaatcccagctctggcctgctggtcaccaagcagaagattgaccgtgatctgctgtgccgccagagccccaagtgcatcatctcgctcgaggtcatgtccagctcaatggaaatctgcgtgataaaggtggagatcaaggacctgaacgacaatgcgcccagtttcccggcagcacagatcgagctggagatctcggaggcagccagccctggcacgcgcatcccgctggacagcgcttacgatccagactcaggaagctttggcgtgcagacttacgagctcacgcccaacgagctgttcggcctggagatcaagacgcgcggcgacggctcccgctttgccgaactcgtggtggaaaagagcctggaccgcgagacgcagtcgcactacagcttccgaatcactgcgctagacggtggcgacccgccgcgcctgggcaccgttggccttagtatcaaggtgaccgactccaatgacaacaacccggtgtttagcgagtccacctacgcggtgagcgtgccagaaaactcgcctcccaacacacccgtcatccgcctcaacgccagcgatccagacgagggcaccaacggccaggtggtctactccttctatggctacgtcaacgaccgcacgcgcgagctctttcagatcgacccgcacagtggcctggtcactgtcactggcgctttagactacgaagaggggcacgtgtacgaactggacgtgcaggctaaggacttggggcccaattccatcccggcacactgcaaggtcaccgtcagcgtgctggacaccaatgacaatccgccggtcatcaacctgctgtcagtcaacagtgagcttgtggaggtcagcgagagcgcccccccgggctacgtgatcgccttggtgcgggtgtctgatcgcgactcaggcctcaatggacgtgtgcagtgccgtttgctgggcaatgtgccctttcgactgcaggaatatgagagcttctccactattctggtggacggacggctggaccgcgagcagcacgaccaatacaacctcacaattcaggcacgcgacggcggcgtgcccatgctgcagagtgccaagtcctttaccgtgctcatcactgacgaaaatgacaaccacccgcacttttccaagccctactaccaggtcattgtgcaggagaacaacacgcctggcgcctatctgctctctgtgtctgctcgcgaccccgacctgggtctcaacggcagtgtctcctaccagatcgtgccgtcgcaggtgcgggacatgcctgtcttcacctatgtctccatcaatcccaactcaggcgacatctacgcgctgcgatcctttaaccacgagcagaccaaggcgttcgaattcaaggtgctggccaaggacggcggccttccctcactgcaaagcaacgctacggtgcgggtcatcatcctcgacgtcaacgacaacaccccggtcatcacagccccacctctgattaacggcactgccgaggtctacataccccgcaactctggcataggctacctggtgactgttgtcaaggcagaagactacgatgagggcgaaaatggccgagtcacctacgacatgaccgagggcgaccgcggcttctttgaaatagaccaggtcaatggcgaagtcagaaccacccgcaccttcggggagagctccaagtcctcctatgagcttatcgtggtggctcacgaccacggcaagacatctctctctgcctctgctctcgtcctaatctacttgtcccctgctctcgatgcccaagagtcaatgggctctgtgaacttgtccttgattttcattattgccctgggctccattgcgggcatcctctttgtaactatgatcttcgtggcaatcaagtgcaagcgagacaacaaagagatccggacctacaactgcagaattgctgagtactcctatgggcatcaaaagaaatcaagcaagaagaaaaaaatcagtaagaatgacatccgcctggtaccccgggatgtggaggagacagacaagatgaacgttgtcagttgctcttccctgacctcctccctcaactattttgactaccaccagcagacgctgcccctgggctgccgccgctctgagagcactttcctgaatgtggagaaccagaatacccgcaacaccagtgctaaccacatctaccatcactctttcaacagccaggggccccagcagcctgacctgattatcaacggtgtgcctctgcctgagactgaaaactattcttttgactccaactacgtgaatagccgagcccatttaatcaagagcagctccaccttcaaggacttagagggcaacagcctgaaggatagtggacatgaggagagtgaccaaactgacagtgagcatgatgtccagcggagcctgtattgtgatactgctgtcaacgatgtgctgaacaccagtgtgacctccatgggatctcagatgcctgatcatgatcagaatgaaggatttcattgccgggaagaatgccggattcttggccactctgacaggtgctggatgccccggaaccccatgcccatccgttccaagtcccctgagcatgtgaggaacatcatcgcgctgtctattgaagctactgctgctgatgtcgaggcttatgacgactgcggccccaccaaacggactttcgcaacctttgggaaagatgtcagcgaccacccggctgaggagaggcctaccctgaaaggcaagaggactgtcgatgtgaccatctgcagccccaaggtcaacagcgttatccgggaggcaggcaatggctgtgaggcgattagccctgtcacctcccccctccacctcaagagctctctgcccaccaagccttccgtgtcttacaccattgccctggctcccccagcccgtgatctggagcagtatgtcaacaatgtcaacaatggccctactcgtccctctgaagctgagccccgtggagctgatagcgagaaagtcatgcatgaggtcagccccattctgaaggaaggtcgcaacaaagagtcccctggtgtgaagcgtctgaaggatatcgttctctaaaccagtctccaggaagaagagaaagaaaccacactggctagtgaagaagcaggagcttcttgttttaattgctcaccaatggttggttcttgagtggctatatttcagagcttttcctaaatgtattgtttataggtgattatcattctgtgacagtcccttgtttcaacaggcagcaggggtgttcagttggagcaaattagctttggcttgagttgttcatggggccttgatgttggggaaacagagacaaattcagttgtgaaaagtattatgtattaagtgtttgaatttatatatttttctatgtcaaaattataatataaattaccattgtttgtggaggattacatttaaaaaagcaaaaagtgaaaaaaaaaagctctggacacctttaataagctcgccactgttttttgtagtgtagacaagttaatggtcatttattgtgtactattcattgattcagtgatgtgaaattgagcccccaaaaggttgtttctgaagctcgagtacttcccaatgccgctactttgctgtggacacccctgctttaaaaacccttttgctagctgtgctattgttgtatttgatattgcaaattgctatgtgtgtggtgatggcaaaaggcttttaaaagttggtgttttctttttcttaaaaaaataataaaactacagacaaaaacaaagtgcaaacaactgagacagcaaatgaatgagcaacaccatgcatatagattgagtacttggagaatactcacgttttttaactcatgtagtgattgctcaccactttgcaaagtatttttcctgcctttcagtggtctgcccaggtccatgatagatcattgcagaaagtcatttttggataggctgctatctaatttgcagttgtcagaaatactgtgctgaaagttttatgacatccatcttttaaattttcaggccctgaacaggaaagttgctcctgaagttatgtttccaggcttagaaattccctctctccaatcatctaaaattgaagatgactgaatctattttaagatctaaattagcatctcttcagacacacacttcctgattcagtgtttcccaatcatgattagaattagactgcaaagcacgtcatgggctgggattgagaactccatgttgctctgtatcttaggcttatatacgtagggatagagtaagcagtacaaagtgtatattttggaaaagacaggtaacaggtaacagcatcgctaatccaattactgtgccttctaaacggagacactcagacacttgaactcatctttttatgactaatagttttttgattaaaaatgtgaacaagaaaatactaaaataaaaatcctttcgatttagccaactctttttgctgtaggctaggaatacaccctttttaaattaacacactgtagatcctttttttctgttttaacattcctctaactcccccatttatcttttgtctattaatattcactagccaacatagtatttttgcagcctaagagttcattatttaaaaataaactaaagaaatatgtcacctttgttctgccttggtcttaagagagttgtttctagagaaacaagttttatggttctgttttcatttgtttcattttttgaaattcaggaatacacagagagaaggcctagaggttagagcactagaatgcaaaagaggatttattttcttaagtttaggtagataagtcagctcttttgaatgttttacttatttttgcctgagttcctagctttacgcattactaggaatattttcttttacaggagggagaagggttttgagggagggggtgggtaaggcagtagggatggggttaggtaggggagaacatttctgaaaaagaacttataatgaagctacaaatccatccttatttcttattcagtgctgaatactacctcatgcaaaatattggtgtggctgcaaatttccctctgaagctgacacaattaaggatgaattaccataacatcttcatttttcctcatttcattgcctctcatacagttttctccctctgatttatttcattttggtagtggattttgaattaagtatttatttctctttgcaagtgactatttgattaacacattaaaaattttttaaaaatttcccctttaagttatgatggctgcctatagaatttagactgtttctcaccctgatccatcctgatattatgttattagctacgatttcaaggtcactttgaagtcagacttcacagttttctacaggtgtatttcttgctatgctcagtgggaaccagggagcagaaaagattgtggaaagtgggaacattaattgtcacgtggctgttgagccagagaggccactggctgccatgcctcttaccagccaagttttaaatggttagagtggcattggcattgattttgcttttctcttgggttttcttcatttcttttcataattcatcttcaagctatagatccatccttcttccctatccaaatactttgttctcagtgggcagtcagatttttttggcttccaaacctcactgagcatgttcagagaattcctctcattaaggaaatatttttccccacaattgtctgatgtatgagtcctctcagaagcacaagtgcatactaggaaggctttgtaaactggttttgtaggcaggctgtacctgcaaataggcattctgagcaaggatcctaaatttccctttggctcatgtcccccccgccccaccccaccttctcctttttggcatgtctggtgaaaagctacaaggttcacagggccaaatattctcccttttgttctctaaacatgttgcacacataaactcaagggagtgatttcggttcctaagtcctagggagttctattccatttattctgatgtcccttttaaggaggagttggtgttgaagtgtgacatgctttaatgataactgctttggcaattccccagacaggtatacttcttcatccaaaattgcacctaaggtgttcatttagacaaaattgttcgcttagtgatccactgatctctaatcagaaatatttttaaaaaatacaatttagatctctgaaaattggaaccactcaagagtatcatcttgatagtgttacttcagcatatgactgactgattttatgaagggagtttagctgacttttccctgtagccctatcatattaaaaacaaaaagtggtccacttgaagcagcaaggacaaagggcagtttagggagaggcagggtgaaggggatagctcgattgggcatccagagtggaaaaggattattattgtacataatagcagttctggctggaattccaatccactttctggggatcattttgatgttgaatgttcccccaaagcattctgacaagtttggtccacttggctctttaccccgggtaataagacccttattgactttgaaaaactggcataaatgagcttaagaaatccattgtatacagtcctagtgtttgccttcttggtaaaattacatttaaggatgtcatttcatgagtcaaattgtatctgctgacactgaagtgtattgagatgttgttctttagtttaagtatgtaacaaagtaatattcaaaggggatgtttgggggtggggctgggaccgggtggctttatattgataatgaaatattccagagcaaaacacattgtcctaatgaagttgttgcagctctcttcgttttcttgtgccgctggaattggcttgtgggtcacttgttgtgcaaaagtgaattaatttcaaataggaatcatattgcttttgtgaaacaaagaaaatttaccaccttgtctgatacatagattggaaggcgctcttggtaaagaataacccacaaacacctgatcttgattggaaagcattgtaggtcattagggaaaactgatgatgctgactgttgctccagctgtgttggcaattcaagatgaccttgttactaactgaaagttgctgtcaaccttagcaaacaaaccagctaacaccattacagcactggttaagtagatttttactggcactggctggcgttcagctgaggaaggctaggatacagactttaatgaccaagagccagactagctcgagctagaaatcagcaacaaatacctccttgtgctatttgaatgctaaggtattagttgcaataggcttacgccttcgctcctctagtgaggggaatgagcctgatgacactattactgtttacctgtcaaaccagggtggaaatttagagggatgcaagtacagtatgtctcattaagcagtctctgttgctgattatatgaagataaaattgttgtatatgctgatctgtatgttatgtacattttcacagtgattgaatcattgtaaaaagaaaaaagacaaaaaagaatcaccactgtctattttatgaagatgataaagcagctttattaaattattacagttatgtttcaaatggtgttatctgccacattgtttccttttatctggtggttctctgtttccccctttaaatgtgttttctctgcttcaaaaatttaatgcattttagtattaaaggctattatggaaaaagtaaaaaaaaaaaaaaaaaa

SEQ ID NO: 342 - protein, 1101 aa, Artificial Sequence
  PCDH19
MESLLLPVLLLLAILWTQAAALINLKYSVEEEQRAGTVIANVAKDAREAGFALDPRQASAFRVVSNSAPHLVDINPSSGLLVTKQKIDRDLLCRQSPKCIISLEVMSSSMEICVIKVEIKDLNDNAPSFPAAQIELEISEAASPGTRIPLDSAYDPDSGSFGVQTYELTPNELFGLEIKTRGDGSRFAELVVEKSLDRETQSHYSFRITALDGGDPPRLGTVGLSIKVTDSNDNNPVFSESTYAVSVPENSPPNTPVIRLNASDPDEGTNGQVVYSFYGYVNDRTRELFQIDPHSGLVTVTGALDYEEGHVYELDVQAKDLGPNSIPAHCKVTVSVLDTNDNPPVINLLSVNSELVEVSESAPPGYVIALVRVSDRDSGLNGRVQCRLLGNVPFRLQEYESFSTILVDGRLDREQHDQYNLTIQARDGGVPMLQSAKSFTVLITDENDNHPHFSKPYYQVIVQENNTPGAYLLSVSARDPDLGLNGSVSYQIVPSQVRDMPVFTYVSINPNSGDIYALRSFNHEQTKAFEFKVLAKDGGLPSLQSNATVRVIILDVNDNTPVITAPPLINGTAEVYIPRNSGIGYLVTVVKAEDYDEGENGRVTYDMTEGDRGFFEIDQVNGEVRTTRTFGESSKSSYELIVVAHDHGKTSLSASALVLIYLSPALDAQESMGSVNLSLIFIIALGSIAGILFVTMIFVAIKCKRDNKEIRTYNCRIAEYSYGHQKKSSKKKKISKNDIRLVPRDVEETDKMNVVSCSSLTSSLNYFDYHQQTLPLGCRRSESTFLNVENQNTRNTSANHIYHHSFNSQGPQQPDLIINGVPLPETENYSFDSNYVNSRAHLIKSSSTFKDLEGNSLKDSGHEESDQTDSEHDVQRSLYCDTAVNDVLNTSVTSMGSQMPDHDQNEGFHCREECRILGHSDRCWMPRNPMPIRSKSPEHVRNIIALSIEATAADVEAYDDCGPTKRTFATFGKDVSDHPAEERPTLKGKRTVDVTICSPKVNSVIREAGNGCEAISPVTSPLHLKSSLPTKPSVSYTIALAPPARDLEQYVNNVNNGPTRPSEAEPRGADSEKVMHEVSPILKEGRNKESPGVKRLKDIVL

SEQ ID NO: 343 - DNA, 6379 bp, Artificial Sequence
  PTPRO
gcggagtctgcaatgggggctgtccagcagtagcaagcagcgggccgatcctggtggagggttgggaggctgctgtcattttatgggtcggcagccagagtgagagtgtccctgctgccagaggactacggcgggctgggcgcggggtccccgcctctcgctcaccacacagaccccgcgcctcctctggcagccgcggtggtggcggcggcagagcctcgcccactccaatccccaccctctccatccttagtcattaaagaacagcagcgcctggcacgttcttggaggaccccgggcgcagaggaggaaagggagcaggcgcagggggactggaaaggcagcatgcgctcgccaggagcaacctcggcgcccagggtctgaggctgcagccccagttcgccattgtgagccgccgccgggggagtccgctagcgcagccgtgcccccgagtccccgtccgcgcagcgatggggcacctgcccacggggatacacggcgcccgccgcctcctgcctctgctctggctctttgtgctgttcaagaatgctacagctttccatgtaactgtccaagatgataataacatcgttgtctcattagaagcttcagacgtcatcagtccagcatctgtgtatgttgtgaagataactggtgaatccaaaaattatttcttcgaatttgaggaattcaacagcactttgcctcctcctgttattttcaaggccagttatcatggcctttattatataatcactctggtagtggtaaatggaaatgtggtgaccaagccatccagatcaatcactgtgttaacaaaacctctacctgtaaccagtgtttccatatatgactataaaccttctcctgaaacaggagtcctgtttgaaatacattatccagaaaaatataacgttttcacaagagtgaacattagctactgggaaggtaaagacttccggacaatgctatataaagatttctttaagggaaaaacagtatttaatcactggctgccaggaatgtgttatagtaatatcacctttcagctggtatctgaggcaacttttaataaaagtacccttgttgagtacagtggtgtcagtcacgaacccaaacagcacagaactgccccttatccacctcaaaatatttccgttcgtatcgtaaacttgaacaaaaacaactgggaagaacagagtggcaatttcccagaagaatccttcatgagatcacaagatacaataggaaaagaaaaactcttccattttacagaagaaacccctgaaattccctcgggcaacatttcttccggttggcctgattttaatagcagtgactatgaaactacgtctcagccatattggtgggacagtgcatctgcagctcctgaaagtgaagatgaatttgtcagcgtacttcccatggaatacgaaaataacagtacactcagtgagacagagaagtcaacatcaggctctttctcctttttccctgtgcaaatgatattgacctggttaccacccaaaccacccactgcttttgatgggttccatatccatattgaacgagaagagaactttactgaatatttgatggtggatgaagaagcacatgaatttgttgcagaactgaaggaacctgggaaatataagttatctgtgacaacctttagttcctcaggatcttgtgaaactcgaaaaagtcagtcagcaaaatcactcagcttttatatcagtccttcaggagagtggattgaagaactgaccgagaagccgcagcacgtgagtgtccacgttttaagctcaaccactgccttgatgtcctggacatcttcccaagagaactacaacagcaccattgtgtctgtggtgtcgctgacctgccagaaacaaaaggagagccagaggcttgaaaagcagtactgcactcaggtgaactcaagcaaacctattattgaaaatctggttcctggtgcccagtaccaggttgtaatatacctaaggaaaggccctttgattggaccaccttcagatcctgtgacatttgctattgttcccacaggaataaaggatttaatgctctatcctttgggtcctacggccgtggttctgagctggaccagaccttatttaggcgtgttcagaaaatacgtggttgaaatgttttatttcaaccctgctacaatgacatcagagtggaccacctactatgaaatagcagcaactgtttccttaactgcatccgtgagaatagctaatctgctgccagcatggtactacaacttccgggttaccatggtgacgtggggagatccagaattgagctgctgtgacagctctaccatcagcttcataacagccccagtggctccggaaatcacttctgtggaatatttcaacagtctgttatatatcagttggacatatggggatgatacaacggacttgtcccattctagaatgcttcactggatggtggttgcagaaggaaaaaagaaaattaaaaagagtgtaacacgcaatgtcatgactgcaattctcagcttgcctccaggcgacatctataacctctcagtaactgcttgtactgaaagaggaagtaatacctccatgctccgccttgtcaagctagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggcgtaggagtatatttgctttcttaaccctgctaccctcatgtctttggactgattatcttttggcattttatattaatccttggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaactgtggctattgtgagcctccgtgtgtgtgcttccaggaggctttgctcctcttcatgcacccgacactgccccttccctggcttccctccatccctgatcatcttcatgaagccacagatataagatcagcttaatattttatcagtgaccttagtgttggtgaaggatgccaaatgaacagctctgcaccccaccgtctcttgtcactgaaaaggcttggccatggcagaccttggcagagtttcttgcaagatctggccagtgagtctcagtttcaccttgcagggtgaatggcagaggatgcccataccctgcaggttaacagcttgggctcctcaggggttgtcagttcctactcacctccctgctaccacctcctcctcttcttctcacccccgactcctttatttccctttttggacattttaataatgtgtcgcaccattctcaggaacaaacatggttaatgaaaggtggcaaagggatgtgtgacattcttagattttcacacatgggcagtcaggagtgaaatgtgcaaccttggaagagctgatacaatgtatggtaagctgaagtacgtttccaacactgctgctcagagcatacagaagttttgcatcctggaacattgcttcccatgaaacaaagcacttcataaatattttatgtttttcttgagcaccctttcaaggtagggatcaaatagtgccagatcaattttcccaaaaggaaagaggaagtatccagagtttagactgaaggcttagagtcaaaactacaggaaggtcacactgttctctggaacactgttgctcttcagtttgtagagtttatgatggaaaaggcatcagtctgtcaaaagacttgtttaatcctgataatgactttggaattatctctcctgggtctcagttaataaactgaagaatgacctaa

SEQ ID NO: 344 - protein, 1216 aa, Artificial Sequence
  PTPRO
MGHLPTGIHGARRLLPLLWLFVLFKNATAFHVTVQDDNNIVVSLEASDVISPASVYVVKITGESKNYFFEFEEFNSTLPPPVIFKASYHGLYYIITLVVVNGNVVTKPSRSITVLTKPLPVTSVSIYDYKPSPETGVLFEIHYPEKYNVFTRVNISYWEGKDFRTMLYKDFFKGKTVFNHWLPGMCYSNITFQLVSEATFNKSTLVEYSGVSHEPKQHRTAPYPPQNISVRIVNLNKNNWEEQSGNFPEESFMRSQDTIGKEKLFHFTEETPEIPSGNISSGWPDFNSSDYETTSQPYWWDSASAAPESEDEFVSVLPMEYENNSTLSETEKSTSGSFSFFPVQMILTWLPPKPPTAFDGFHIHIEREENFTEYLMVDEEAHEFVAELKEPGKYKLSVTTFSSSGSCETRKSQSAKSLSFYISPSGEWIEELTEKPQHVSVHVLSSTTALMSWTSSQENYNSTIVSVVSLTCQKQKESQRLEKQYCTQVNSSKPIIENLVPGAQYQVVIYLRKGPLIGPPSDPVTFAIVPTGIKDLMLYPLGPTAVVLSWTRPYLGVFRKYVVEMFYFNPATMTSEWTTYYEIAATVSLTASVRIANLLPAWYYNFRVTMVTWGDPELSCCDSSTISFITAPVAPEITSVEYFNSLLYISWTYGDDTTDLSHSRMLHWMVVAEGKKKIKKSVTRNVMTAILSLPPGDIYNLSVTACTERGSNTSMLRLVKLEPAPPKSLFAVNKTQTSVTLLWVEEGVADFFEVFCQQVGSSQKTKLQEPVAVSSHVVTISSLLPATAYNCSVTSFSHDSPSVPTFIAVSTMVTEMNPNVVVISVLAILSTLLIGLLLVTLIILRKKHLQMARECGAGTFVNFASLERDGKLPYNWRRSIFAFLTLLPSCLWTDYLLAFYINPWSKNGLKKRKLTNPVQLDDFDAYIKDMAKDSDYKFSLQFEELKLIGLDIPHFAADLPLNRCKNRYTNILPYDFSRVRLVSMNEEEGADYINANYIPGYNSPQEYIATQGPLPETRNDFWKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCSAGVGRTGTFIALDRLLQHIRDHEFVDILGLVSEMRSYRMSMVQTEEQYIFIHQCVQLMWMKKKQQFCISDVIYENVSKS

SEQ ID NO: 345 - DNA, 5730 bp, Artificial Sequence
  SATB2
aaattattattttgaaggcgctagatctggggaccgaaagggggagggggagaaatcggaaaccgaggacaacccaaaaggactcactttgcctgatgactcaacgcaactaataatcatctccctctcagtgtgtctctctctgcggcttgtcagtgagtccggctctggctgctggcagaggcggccgagaggggagaggctggaggtgacagcttgggcggccgccgcgtttcctcccgcgcgcggtcccgggtccctgcgtcttctcggctcttggtgttaccggtcccaccgctctggccgcgcctcctcgcgagctagccgccctgcgaaccagcagccccggctcgccgccgccgccgccgcctccgggttctcagccctttctctccagaacgggtctccttcccgaaggtgtgaaaaggctctttcagcctccttctcttcccccctcctccgccgtcccctcccccgctcgctcgggtgtccctttggaggagtcctttccctctcctcctcctccccctcctccctccccccatcatcatcataacaaccatctccgcaccagaagaagacaccctgacccaggaccttaaacattaggacctggggaagagggaaggggaaggagtaaagaggaagactaggagaacactgcaaagccaagcaccagaaactttccaccctggattctctacttttgctccatggacagagccccagtcagccaagtttcagacagaccgtgagcagtccctgtgcgttttattgcgacctgccggtgggaactttgtctccgagtcggagcagcatggagcggcggagcgagagcccgtgtctgcgggacagccccgaccggcggagcggcagcccggacgtcaaggggcctcccccagtgaaggtggcccggctggagcagaacggcagccccatgggagcccgcgggaggcccaacggcgccgtggccaaggccgtgggaggtttgatgattcctgtcttttgtgtcgtggagcagttggacggctctcttgaatatgacaacagagaagaacacgccgagtttgtcctggtgcggaaagatgtgctttttagccagctggtggagactgcgctcctggccctggggtattctcacagctctgcggcccaggcccaaggaataatcaagctgggaaggtggaaccctctccccctcagttatgtgacagatgcacccgacgcgacagtggccgacatgctacaagatgtctatcatgttgtgacgttgaaaatccaattacaaagttgttcaaagttggaagacttgcctgcggagcagtggaaccatgccacagtccgcaatgccttaaaggaactgctcaaagagatgaaccagagcacattagccaaagaatgccctctctcccagagtatgatttcatccattgtaaatagcacatattatgccaatgtgtcagcaaccaagtgccaggagtttgggagatggtataaaaagtacaagaagattaaagtggaaagagtggaacgagaaaacctttcagactattgtgttctgggccagcgtccaatgcatttaccaaatatgaaccagctggcatccctggggaaaaccaacgaacagtctcctcacagccaaattcaccacagtactccaatccgaaaccaagtgcccgcattacagcccatcatgagccctggtcttctttctccccagcttagtccacaacttgtaaggcaacaaatagccatggcccatctgataaaccaacagattgccgttagccggctcctggctcaccagcatcctcaagccatcaaccagcagttcctgaaccatccacccatccccagagcagttaagccagagccaaccaactcttccgtggaagtctctccagatatctaccagcaagtcagagatgagctgaagagggccagtgtgtcccaagctgtctttgcaagagtggcattcaaccgcacacagggattgttgtctgagattctgcgtaaggaagaagaccctcggacagcctctcagtctcttctagtaaacctgagggccatgcagaatttcctcaatctgccagaagtggagcgagatcgcatctaccaggatgagagggagcggagcatgaatcccaatgtgagcatggtctcctcggcctccagcagtcccagctcctcccgaacccctcaggccaaaacctcgacaccgacaacagacctccctattaaggtggacggcgccaacatcaacatcacagctgccatttatgacgagatccaacaggagatgaaaagggccaaggtgtctcaagccctgtttgccaaagtggctgcaaataaaagtcagggctggctgtgtgaactgctccgctggaaggagaacccaagcccagaaaaccgcaccctctgggaaaacctctgtaccatccgtcgcttcctgaaccttccccagcatgagagggatgtcatctatgaggaggagtcaaggcatcaccacagcgaacgcatgcaacacgtggtccagcttccccctgagccggtgcaggtacttcatagacagcagtctcagccagccaaggagagttcccctcccagagaagaagcgcctcccccacctcctccgactgaagacagttgtgccaaaaagccccggtctcgcacaaagatctccttagaagccctggggatcctccaaagctttattcatgatgtaggcctgtacccagaccaggaagccatccacactctttcggctcagctggatctccccaaacacaccatcatcaagttcttccagaaccagcggtaccacgtgaagcaccacgggaagctgaaagagcacctgggctccgcggtggacgtggctgaatataaggacgaggagctgctgaccgagtcagaggagaacgacagcgaggaaggctccgaggagatgtacaaagtggaggctgaggaggaaaatgctgacaaaagcaaggcagcacctgccgaaattgaccagagataatgtgaacttctactaggcaaagcaatacatcggtccaaggattttctgctttcatttctttaaaagttttttgttagtttgttttttgtttttgtttttgggtttttttggctttatttttgtctttttatgtctgttttgtttttcttacccttttggacatttctttgttgcacaggatacacctatagactgaataagttcagtatttccgaatcagacatcgccttggcaaagacactaaagcgttacactttatcccgtctctatgactggatcatagtcattataatcacaggagactctgccttcattatccttgcacttaacggaagttacatcaggcaagtaccaggatgaaaagaactatgaaataaatgaaggaagctacaagtgtgtgtgtatatgtatatgtatatatctctatatttacatatatatattaaaattgcatgggacagagactttgcaatccgaaagaatagactgtgaaatgagttcttaaagaaaagacttgtttatgtattaaaaaaaccacttcacagtgagtcgctttggctttttgataaactgcggcctgctctcagggtggggtgactatttttgaattcctatttattttttgtgtttgtccctgattttttttttttaattctatggcttcctatctggcagcttaatgggtaatttttgaggtatgtatttaacaaaataaacgacactgccgaaaaaaaaaaaagtgaagtgaaaacaatcagggcacattaaaatgatacaagtcaaataaatcttaaagacacaatgcacacttaaaatgactcaataaaatgacttgctacgttccgttattcaatttgtcattactgtagtgaacagatgcatttctgtggaattccaaataagtaaaactgaaattcagtgcagagaaaactttgtccactagtgcaagtcttgatcaaatgacattttgacattggacatatggaattcatagtatgagccacattttgttgtgaaatttatttacctgcttgtggcttcaaatctgaaaattaataagcctgctcgtttaaaagttgtttgttgttgctgtttttttgtctttttgttttttactagaaaatagttcagtgtaatattaagttagaaaagaagttgctgcccagttaaaggggctccctctcaaataaatctccatccttccctctcccaaaagacatttctgatttctgcttcactttgggcttcctcttcttcgtacacattccatctacctaatcaaacattttcagtccctgatctctcctgtcccttttcctgggatgacagccctaacaagaactgtttttgaatcgttgtgcagctccaggcaatagagtatgtgaagcgatttcagtagaatcacttactcatcctaaaagaaaacattatcccagttacctacatcgcaattaccttatgtaaagcagaactaatgctgactggatgtttaatgggatgagcattaaagctgcaatctactatagtactccagatctctttcggcttcctatgagaaacaccagaagcattactttccacttctacttacagtaattgcaagaggagacctcacattcaggactggcctagtgaacgtaatccatgctttaaactggccattaaacagtcccacatggttggattttttttttttttttgagttgtgctttcacaaaaccttgtcaaagacctcatgcaatatcactttgaaagttattttctgtttactacacaaacattgtaatataactgttaatactatttatatatttgaaaggtataaaaggtaggagttaaaaaaaaaacctctatgtgtagatattaactcagaacttacaatatacagggagaagacatgttgcaatacaagctaattctagctgctcagtaacctctggagtttttaaagggacattttcctgtactttttcaaataatgatgtttaaaaattatcttgacataagcgtcatatacctttgcaaaaggatggttgtttgcagttagccctggccccatccttcctatttctgtagtatgctgcagctttaatcagaaagtccatggttgctgcttcctgatctccgagttactctttccaaattgtcttcttacactgttgctgaaggtcactctgtacacgtaatggaaactgattttgccaagctcttacaaggtggttcatctatcgatggcatccgcatttggtatcttttacacttcaaccaaaaatttattaggtatttttcaatgctaagtcttgccttttattttttaatttcactgccaagtttgcagtggttctaagtgaatctgtgggcattttagcctgtggtcttgccagatctttgcgaattacaatgcatatatgtctatttattcaatatctgtcatataatatctatttggaagaagaaactttctcttgtagtgcctcttgacaaagcacaatttcccgcctttttttttttttgtgaaatgaaaaaaacaaattgtgttttattgcggtatcaacaatgtgaataaggattaacatattgtaaatgttcttttttccatgtaaatcaactatctttgttatcactaagtgataattaatttttaacttatgtgcattgttaggctgttagaattttttggttgttaaaataaacgcattcaataaatatga

SEQ ID NO: 346 - protein, 733 aa, Artificial Sequence
  SATB2
MERRSESPCLRDSPDRRSGSPDVKGPPPVKVARLEQNGSPMGARGRPNGAVAKAVGGLMIPVFCVVEQLDGSLEYDNREEHAEFVLVRKDVLFSQLVETALLALGYSHSSAAQAQGIIKLGRWNPLPLSYVTDAPDATVADMLQDVYHVVTLKIQLQSCSKLEDLPAEQWNHATVRNALKELLKEMNQSTLAKECPLSQSMISSIVNSTYYANVSATKCQEFGRWYKKYKKIKVERVERENLSDYCVLGQRPMHLPNMNQLASLGKTNEQSPHSQIHHSTPIRNQVPALQPIMSPGLLSPQLSPQLVRQQIAMAHLINQQIAVSRLLAHQHPQAINQQFLNHPPIPRAVKPEPTNSSVEVSPDIYQQVRDELKRASVSQAVFARVAFNRTQGLLSEILRKEEDPRTASQSLLVNLRAMQNFLNLPEVERDRIYQDERERSMNPNVSMVSSASSSPSSSRTPQAKTSTPTTDLPIKVDGANINITAAIYDEIQQEMKRAKVSQALFAKVAANKSQGWLCELLRWKENPSPENRTLWENLCTIRRFLNLPQHERDVIYEEESRHHHSERMQHVVQLPPEPVQVLHRQQSQPAKESSPPREEAPPPPPPTEDSCAKKPRSRTKISLEALGILQSFIHDVGLYPDQEAIHTLSAQLDLPKHTIIKFFQNQRYHVKHHGKLKEHLGSAVDVAEYKDEELLTESEENDSEEGSEEMYKVEAEEENADKSKAAPAEIDQR

SEQ ID NO: 347 - DNA, 2705 bp, Artificial Sequence
  FGF13
gtgccgcgcccagagcagcagcaacagcgaagatgcgaggccattacctgtttgatccctgtcggaaacctggcacgggccaacttttcccgattatcacgccaagaagttgcaaggactagtcgaagactcggaggggccagggcgagggcgcgctcccccgcgcgctgcctcgtccctcctccgtccggccgcccgagctcccggcctctctcccgcccgcgctcactccctccgcccgcctccctcctctggcccccatcagaagggcaacagggcgagggggtccggcgaaattcggaccggagcagctggacatgcacggtgtccgccgggcgcaggggccgaccacacgcagtcgcgcagttcagcatccgcgtgccagtctcgcccgcgatcccgggcccggggctgtggcgtcgactccgacccaggcagccagcagcccgcgcgggagccggaccgccgccggaggagctcggacggcatgctgagccccctccttggctgaagcccgagtgcggagaagcccgggcaaacgcaggctaaggagaccaaagcggcgaagtcgcgagacagcggacaagcagcggaggagaaggaggaggaggcgaacccagagaggggcagcaaaagaagcggtggtggtgggcgtcgtggccatggcggcggctatcgccagctcgctcatccgtcagaagaggcaagcccgcgagcgcgagaaatccaacgcctgcaagtgtgtcagcagccccagcaaaggcaagaccagctgcgacaaaaacaagttaaatgtcttttcccgggtcaaactcttcggctccaagaagaggcgcagaagaagaccagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccattagaccttcttatcatccatactaaagccccattatttagattgagcttgtgcataagaatgccaagcattttagtgaactaaatctgagagaaggactgccaaattttctcatgatctcacctatactttggggatgataatccaaaagtatttcacagcactaatgctgatcaaaatttgctctcccaccaagaaaatgtaaaagaccacaattgttcttcaaaaacaaacaaaacaaaacaaaacaaaattaactgcttaaatgttttgtcggggcaaacaaaattatgtgaattgtgttgttttcttggcttgatgttttctatctacgcttgattcacatgtactcttttctttggcatagtgcaactttatgatttctgaaattcaatggttctattgactttttgcgtcacttaatccaaatcaaccaaattcagggttgaatctgaattggcttctcaggctcaaggtaacagtgttcttgtggtttgaccaattgtttttctttctttttttttttttttagatttgtggtattctggtcaagttattgtgctgtactttgtgcgtagaaattgagttgtattgtcaaccccagtcagtaaagagaacttcaaaaaattatcctcaagtgtagatttctcttaattccatttgtgtatcatgttaaactattgttgtggcttcttgtgtaaagacaggaactgtggaactgtgatgttgtcttttgtgttgttaaaataagaaatgtcttatctgtatatgtatgagtcttcctgtcattgtatttggcacatgaatattgtgtacaaggaattgttaagactggttttccctcaacaacatatattatacttgctactggaaaagtgtttaagacttagctaggtttccatttagatcttcatatctgttgcatggaagaaagttgggttcttggcatagagttgcatgatatgtaagattttgtgcattcataattgttaaaaatctgtgttccaaaagtggacatagcatgtacaggcagttttctgtcctgtgcacaaaaagtttaaaaaagttgtttaatatttgttgttgtatacccaaatacgcaccgaataaactctttatattcattcaaagaaaaaaaaaaaaaaaaaaaaaaaaaaaaaa

SEQ ID NO: 348 - protein, 245 aa, Artificial Sequence
  FGF13
MAAAIASSLIRQKRQAREREKSNACKCVSSPSKGKTSCDKNKLNVFSRVKLFGSKKRRRRRPEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 349 - DNA, 5744 bp, Artificial Sequence
  CXADR
ggcaaccccacgcggctggagaagccggcgctcgcagcccggcccgggccgctgccggaagtgacgcgagttcacctgccgagcgggggctgggaggaggggcggagggtgcagaggtgccgccgccgccgcgagccagtcgggagcgcgcgaggcgcggggagcctgggaccaggagcgagagccgcctacctgcagccgccgcccacggcacggcagccaccatggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgttaagccttcaggtgcgagatgttacgttgatggatctgaagaaattggaagtgactttaagataaaatgtgaaccaaaagaaggttcacttccattacagtatgagtggcaaaaattgtctgactcacagaaaatgcccacttcatggttagcagaaatgacttcatctgttatatctgtaaaaaatgcctcttctgagtactctgggacatacagctgtacagtcagaaacagagtgggctctgatcagtgcctgttgcgtctaaacgttgtccctccttcaaataaagctggactaattgcaggagccattataggaactttgcttgctctagcgctcattggtcttatcatcttttgctgtcgtaaaaagcgcagagaagaaaaatatgaaaaggaagttcatcacgatatcagggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaaggtagctgcccctaatctaagtcgaatgggtgcgattcctgtgatgattccagcacagagcaaggatgggtctatagtatagagcctccatatgtctcatctgtgctctccgtgttcctttcctttttttgatatatgaaaacctattctggtctaaattgtgttactagcctcaaaatacatcaaaaaataagttaatcaggaactgtacggaatatatttttaaaaatttttgtttggttatatcgaaatagttacaggcactaaagttagtaaagaaaagtttaccatctgaaaaagctggattttctttaagaggttgattataaagttttctaaatttatcagtacctaagtaagatgtagcgctttgaatatgaaatcataggtgaagacatgggtgaacttacttgcataccaagttgatacttgaataaccatctgaaagtggtacttgatcatttttaccattatttttaggatgtgtatttcatttatttatggcccaccagtctcccccaaattagtacagaaatatccatgacaaaattacttacgtatgtttgtacttggttttacagctcctttgaaaactctgtgtttggaatatctctaaaaacatagaaaacactacagtggtttagaaattactaattttacttctaagtcattcataaaccttgtctatgaaatgacttcttaaatatttagttgatagactgctacaggtaatagggacttagcaagctcttttatatgctaaaggagcatctatcagattaagttagaacatttgctgtcagccacatattgagatgacactaggtgcaatagcagggatagattttgttggtgagtagtctcatgccttgagatctgtggtggtcttcaaaatggtggccagccagatcaaggatgtagtatctcatagttcccaggtgatatttttcttattagaaaaatattataactcatttgttgtttgacacttatagattgaaatttcctaatttattctaaattttaagtggttctttggttccagtgctttatgttgttgttgtttttggatggtgttacatattatatgttctagaaacatgtaatcctaaatttaccctcttgaatataatccctggatgatattttttatcataaatgcagaataatcaaatacattttaagcaagttaagtgtcctccatcaattctgtattccagacttgggaggatgtacagttgctgttgtgtgatcaaacatgtctctgtgtagttccagcaaatcaagctgagctttgaaaaagtttgtcttagttttgtgaaggtgatttattcttaaaaaaaaaaaagaaagaaaaagaaaaaaagataagaaggaggagtaaagggactactcctccttgccaaatgtgctaaatatcattttaggagaagaaagtgggtttattgtatttcccttaagattgtgagggagtgtggatacagtagaatgagccaacagtttctttataataaatacggtctgcaataaattatttcactagctctaaaacctttccctagattttagtagggagttggtttctgttaatatctttgggtgctgtggtggtaaatgctatattatgaacggtggcatgtatttacagttagagtattgtgtgtacactttttaatggtaaacttaagctgaatgtgtaatggatttgtgtatagttttacatatttggaagcattttaaaaacaggttttaaccttatgtaaaattacttttatactcgtgttaacattttcatctgtgccttttggtaatttaatttctattatgaatttctggtgcctatgagctagctatcacctacctgaaaggtgcttagaggtgaaggtactgtttctaaaaacacatcactgtgatacctttctatcctcacattttcaagcttgcctcttttctgttctttgtggatataacttaagcaattgtgttattcataaaggtttagaaatttcaatattcccaacactctatgtttctgattttataacagtagccatttttgaaagtcagatgtttggcctgttttatatgaataaagtttatttataaaatattataaaaaataagtaaataaacagaacattaataataaagttttggttcttcctattcctgactttcatataatgaaaattatcctattgatctaagtagaagttatcatagaaagtggacacgtataagactttccttcctttttttttttaataacatatgaggaacaagacttctcttcccatatacttcatattttagaggacattgttttaaaggcttatgtctcactgtaaaattctgtcagccaaatagtaccaatacgttttcaagtagttctcactgataatttagttgaaccagagatcaaatatttgctcccgaattactactggtaatcaagtagttgaacaaaaaattactaaagcatttccgttagatcagtcaaggacagtactgcatctttttttttttttttttttttaagacggagtctcggtctgtcacccaggctggagtgcagtggcgggatctcggctcactgcaagctccgcctcccaggttcacgccattctcctgcctcagcctcccgagcagctgggactacaggctcccatcaccacgctcggctaagtttttgtaattttagtagagacagggtttcaccgtgttagccaggatggtctcgatctcctgacctcgtgatctgcctgcctcggcctcccaaagtgctgggattacaggcgtgaaccactgcacccggcccagtactgcatcttaacagcaaagccattttattctactttataactgagagacttgataccatccatctctttaggttacagaggataatttgaagagaaatgttactgtagaatatatagttctgtactttttttttttttttttaagagatagggtttcactattgctcaggctggtctcaaactgctgggctcaggagatcctcctgccttggcctcccaaattgctgggattacaggtgtgagccgcagcatccagccagttctgtactttgaatatggagtagtttacagctatttttttttcttactggtaatcttaactaatatgattcccttgttagagagcctctcactcccccacccccaaaaatgtctactattcatgacagtaaccaattattctggacaaattgcttctttttaatttgagctatctgccatggactttctaaaatggaaacacagcctgagtgtatcttagggagagtttgattgaaaaaatccaaatcactatccatatagatcatggatataaagagatacctgatttttattaaaaagatactttttcaaatttaagagttaatcttggaaatttggaacaagtaaaggggcaagtaaaccttttgatgaaatataaaaggaactcattgcatgaagttgactatcaaattctgtgatgtgtggcttcttaaaaatattctcagtgtcttttgtgtgcgtgcagcatgtacatttgatgttatgtgaatgttgagttttttcttctaattttcacttcagcagtgtttagggctttcagatgccttattccagtgtgaacagaaaaagttcatattttatgtggttaatgctttgatgtgtcacataaagagtagtttgtagaaaatgttggcacaattttaacttcttagtggcttgtgacattatatattatatatatatatgtacatatatctttataacattcctgtgtttagtagtgtaaatgttctgggcaagttttaatattttgaatgcctttggatattccagcaataaaggcatcatgttctgcaataggatttcttactcatttacctattttaacactaaaatagaccacaactgagcacaaattccttttataaatgttatagaagcagggaagaataataaacacatttgtgaattgtggttcagtttatttatctttagggaaggctgatcatttatcttatagcagataaccccagcctcttattcattatggttaacttttataatttatcttattttataatttaagaatatagtacatatcagttgggtttggttttggtcatcgagactaaaagctccatcaaaacagaactttgtgttttctgctaacttatttaatgacacaagttttaagagaaccacaattcattgattcacttattcttttccctaattgtgaattttagtgataaatacacctgtactactgaggaaaatattctgacacttcacgtgtgcaaagtatagaactgacagtgtcagtttcagattttgtatgtacgatttctggcttatatatccaatggtgcagattttgaaatttgtaagaacaaaatttgttaagaaaaacaacttgctctagttttgtgaccttgtgtacttttgaaataaaatcaagaaagcagttctctgcctcaaaa

SEQ ID NO: 350 - protein, 365 aa, Artificial Sequence
  CXADR
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEMTSSVISVKNASSEYSGTYSCTVRNRVGSDQCLLRLNVVPPSNKAGLIAGAIIGTLLALALIGLIIFCCRKKRREEKYEKEVHHDIREDVPPPKSRTSTARSYIGSNHSSLGSMSPSNMEGYSKTQYNQVPSEDFERTPQSPTLPPAKVAAPNLSRMGAIPVMIPAQSKDGSIV

SEQ ID NO: 351 - DNA, 2180 bp, Artificial Sequence
  MLLT11
ggcgcactgctcccctctggactgcggaggcactgcactgcgcgggacgtgggagggtgcctctgcagcccctcaaggccgccgcccctgcggggagaactggagaatgcggacacctagatgaggccctggcacccaagctggggcccccggaatctcacgttccctttactcgccaggcatttcggggcaaaacgaagcggagccccccaaacccccagacctaaccaagttcagagattcgcagaagcacgccccccaccccaaatttattgtgctctacccaaaatggaataggactaggtttatttacccattgtgagggtagagaggcgagtctggaggagcagggattgggagaaggggtggaaaaatactctgattcttaaaaatactttgtaacctaaagtccttaaattgtggaagaaaggaatactcctcctttccattgtagtctagagttaagatttcaaatccataaattagaggacctaaaattagagggcaattaactgctcattcattgggcccccagtcagcacgggggtgctggaagagatcgggaataatagcgcagaccaatgagcctagggagatgctttcatcgtctctccttccctcaagtgttctggaacctatcatttgaattagccgagtcaggcaggagggggcggggaatccttccgcccttcttaggaggggctgcattgcagggggagagtgaactgacagactcagtcactgaagagggaaaaggagtgagaagacaaagccgtcaaagccccaacagctttgtatttctccagcccggcgcagaccccggagctcccgaggcactccctccatctttggaacacgccagtaattgattgataacaggaagctatgagggaccctgtgagtagccagtacagttcctttcttttctggaggatgcccatcccagaactggatctgtcggagctggaaggcctgggtctgtcagatacagccacctacaaggtcaaagacagcagcgttggcaaaatgatcgggcaagcaactgcagcagaccaggagaaaaaccctgaaggtgatggcctccttgagtacagcaccttcaacttctggagagctcccattgccagcatccactccttcgaactggacttgctctaaggccaagacttctctctcccatcaccttgccctcattgtcttccctctcaagccccttcctttccactcctttcccattttaatcttgttctctccctactgtgttggtggtgctgatgaatctgccagagttgagttctatgtatttatttatctatctgtctactccatttctctcaaaagccctcaagtcacaaagtaaatggttcaagcaatggagtactgggtcacagggattcctcctttcccccccaaatattaactccagaaactaggcctgactggggacacctgagagtagtatagtagtgcaaaatggaagactgatttttgactctattataatcagcttcagagattccttaaaccttcctaatttcctgctccagggcagtaaacacaaatatttcttcaaggggtgatgaaaacctcggaagttttaatttgaggttatctgctacgaaacagtatttctaaaaggctaaagtgataagtctcttgcttttttttgatcctgctcttatattcttttttttcctcagagaaatcaggagggtagttagaggtataaaacaggaggaaatattatggaaaatgaaaatagggaaaataattgaatcattttagaagtagctaatttcttttctcaaaagagtgtcccttcttcacacctactcactttacaactttgctcctaactgtgggttgaaaactctagctaaagaaagttatcaaatcttaacatgcattcctactattatgatagtttttaaggtttcaattcaatcttctgaacggcataagtcctattttagccttacctcctgcatttgcaatacgtaatactgatcagtgggcacagttcttcagctacattgagaccctgaaatgaacaattatattctgactcgacatcttgtccccaatccttccaaaaatattgatggtgatttgtgctaccatttactcgtttatttaataaagacattcaatcccaggaaaaaaaaaaaaaaaaaaaaaaa

SEQ ID NO: 352 - protein, 90 aa, Artificial Sequence
  MLLT11
MRDPVSSQYSSFLFWRMPIPELDLSELEGLGLSDTATYKVKDSSVGKMIGQATAADQEKNPEGDGLLEYSTFNFWRAPIASIHSFELDLL

SEQ ID NO: 353 - DNA, 2816 bp, Artificial Sequence
  TMEFF2
agagggatgcgggcggcagagctcgagaggcggctgccgggctgcggggcgccttgactctccctccaccctgcctcctcgggctccactcgtctgcccctggactcccgtctcctcctgtcctccggcttcccagagctccctccttatggcagcagcttcccgcgtctccggcgcagcttctcagcggacgaccctctcgctccggggctgagcccagtccctggatgttgctgaaactctcgagatcatgcgcgggtttggctgctgcttccccgccgggtgccactgccaccgccgccgcctctgctgccgccgtccgcgggatgctcagtagcccgctgcccggcccccgcgatcctgtgttcctcggaagccgtttgctgctgcagagttgcacgaactagtcatggtgctgtgggagtccccgcggcagtgcagcagctggacactttgcgagggcttttgctggctgctgctgctgcccgtcatgctactcatcgtagcccgcccggtgaagctcgctgctttccctacctccttaagtgactgccaaacgcccaccggctggaattgctctggttatgatgacagagaaaatgatctcttcctctgtgacaccaacacctgtaaatttgatggggaatgtttaagaattggagacactgtgacttgcgtctgtcagttcaagtgcaacaatgactatgtgcctgtgtgtggctccaatggggagagctaccagaatgagtgttacctgcgacaggctgcatgcaaacagcagagtgagatacttgtggtgtcagaaggatcatgtgccacagatgcaggatcaggatctggagatggagtccatgaaggctctggagaaactagtcaaaaggagacatccacctgtgatatttgccagtttggtgcagaatgtgacgaagatgccgaggatgtctggtgtgtgtgtaatattgactgttctcaaaccaacttcaatcccctctgcgcttctgatgggaaatcttatgataatgcatgccaaatcaaagaagcatcgtgtcagaaacaggagaaaattgaagtcatgtctttgggtcgatgtcaagataacacaactacaactactaagtctgaagatgggcattatgcaagaacagattatgcagagaatgctaacaaattagaagaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaaggaaatgccccagaagcaacagaattcacagacagaagcaaaatacagggcactacagttcagacaatacaacaagagcgtccacgaggttaatctaaagggagcatgtttcacagtggctggactaccgagagcttggactacacaatacagtattatagacaaaagaataagacaagagatctacacatgttgccttgcatttgtggtaatctacaccaatgaaaacatgtactacagctatatttgattatgtatggatatatttgaaatagtatacattgtcttgatgttttttctgtaatgtaaataaactatttatatcacacaatatagttttttctttcccatgtatttgttatatataataaatactcagtgatgagaaaaaattggcattcttaaatttgcggtatctcataactgtaaatataatcagactagtacaatctgtacagctaccaatatttcatgtttcttctcatcttgagacagcacattagttcgtacaggactcagtggctaggttttgaatgattccaagatcaagggaaatgatggttattggaaaagagaaaaaataatttactttatatcgagtgaggataaaatatttccgatctttgaatcatctctatttcatcaactttcttccctggtcttccattttcatccctagagcagaaaaatctctggcatataaactaaataaaagaagaaggggagggaaagtgttttataactcataaaggagagggaaagaaaatattggtttttattggggaagtagcttagaatcccccagttaagtgcatatatctgaacttactgaacaagttacatactaggtatacacagagtggcaaaatatattccatttaggtgggtggaattaccaggggaaaaatgtaataacaccactagatgtgaaacaccaaaatcgtgaattctcaaaagcaccatacaatatgtatagtatatagttctttgaaaagaagttagaatcacaaccaataccccatgaatagctttgtggctaatgcagcaccataatttgtaatggaactaagatgatgatgacgatatttcatgaaaacagagagatgttttgagcatatttatgtggtgaggtaagaaagaaaattaatcctatagcatctgaaagacctcactgggaagttggtatggatttttgtttgatttgtgcatacaaataggtatcacaacttgatctggaaaaaataagctgtgaaaattctcaaggaataagatgaaaataaatcaattattatcatttagctctgcaaagctttccatggctaacacagtaaatttaaataaagctctctttgtctccttcaaaaaaaaaaaaaaaaaaaa

SEQ ID NO: 354 - protein, 374 aa, Artificial Sequence
  TMEFF2
MVLWESPRQCSSWTLCEGFCWLLLLPVMLLIVARPVKLAAFPTSLSDCQTPTGWNCSGYDDRENDLFLCDTNTCKFDGECLRIGDTVTCVCQFKCNNDYVPVCGSNGESYQNECYLRQAACKQQSEILVVSEGSCATDAGSGSGDGVHEGSGETSQKETSTCDICQFGAECDEDAEDVWCVCNIDCSQTNFNPLCASDGKSYDNACQIKEASCQKQEKIEVMSLGRCQDNTTTTTKSEDGHYARTDYAENANKLEESAREHHIPCPEHYNGFCMHGKCEHSINMQEPSCRCDAGYTGQHCEKKDYSVLYVVPGPVRFQYVLIAAVIGTIQIAVICVVVLCITRKCPRSNRIHRQKQNTGHYSSDNTTRASTRLI

SEQ ID NO: 355 - DNA, 3109 bp, Artificial Sequence
  BRSK1
gggggccggccagaaacgggctggggagggggggccccgcagcccccctgggccatgctgactcccggggcctgacccccccgggccagccccccctcccccagctccgcggcccgccgactggggggggccagcccagccccctggggacccccggagaggtggggggcagccgggggggccgggacggagcggtcgccggcccccaccggagagacggggcgacggccgcagggggggcggccgggggaccggtcgggccgggaccaagggcaccatgtcgtccggggccaaggagggaggtgggggctctcccgcctaccacctcccccacccccacccccacccaccccagcacgcccaatatgtgggcccctatcggctggagaagacgctgggcaaaggacagacagggctggttaaactcggggtccactgcatcacgggtcagaaggtcgccatcaagatcgtgaaccgggagaagctgtcggagtcggtgctgatgaaggtggagcgggagatcgccatcctgaagctcatcgaacacccacatgtcctcaagctccacgacgtctacgagaacaagaaatatttgtacctggttctggagcacgtctcggggggtgagctattcgactacctggtaaagaaggggagactgacgcccaaggaggcccgaaagttcttccgccagattgtgtctgcgctggacttctgccacagctactccatctgccacagagacctaaagcccgagaacctgcttttggatgagaaaaacaacatccgcattgcagacttcggcatggcgtccctgcaggtgggggacagcctcctggagaccagctgcgggtccccccattatgcgtgtccagaggtgattaagggggaaaaatatgatggccgccgggcagacatgtggagctgtggagtcatcctcttcgccctgctcgtgggggctctgccctttgatgacgacaacctccgccagctgctggagaaggtgaaacggggcgtcttccacatgccccacttcattcctccagattgccagagcctcctgaggggaatgatcgaagtggagcccgaaaaaaggctcagtctggagcaaattcagaaacatccttggtacctaggcgggaaacacgagccagacccgtgcctggagccagcccctggccgccgggtagccatgcggagcctgccatccaacggagagctggaccccgacgtcctagagagcatggcatcactgggctgcttcagggaccgcgagaggctgcatcgcgagctgcgcagtgaggaggagaaccaagaaaagatgatatattatctgcttttggatcggaaggagcggtatcccagctgtgaggaccaggacctgcctccccggaatgatgttgaccccccccggaagcgtgtggattctcccatgctgagccgtcacgggaagcggcgaccagagcggaagtccatggaagtcctgagcatcaccgatgccgggggtggtggctcccctgtacccacccgacgggccttggagatggcccagcacagccagagatcccgtagcgtcagtggagcctccacgggtctgtcctccagccctctaagcagcccaaggagtccggtcttttccttttcaccggagccgggggctggagatgaggctcgaggcgggggctccccgacttccaaaacgcagacgctgccttctcggggccccaggggtgggggcgccggggagcagcccccgccccccagtgcccgctccacacccctgcccggccccccaggctccccgcgctcctctggcgggacccccttgcactcgcctctgcacacgccccgggccagtcccaccgggaccccggggacaacaccaccccccagccccggcggtggcgtcgggggagccgcctggaggagtcgtctcaactccatccgcaacagcttcctgggctcccctcgctttcaccggcgcaagatgcaggtccctaccgctgaggagatgtccagcttgacgccagagtcctccccggagctggcaaaacgctcctggttcgggaacttcatctccttggacaaagaagaacaaatattcctcgtgctaaaggacaaacctctcagcagcatcaaagcagacatcgtccatgcctttctgtcgatccccagcctgagtcacagtgtgctgtcacagaccagcttcagggccgagtacaaggccagtggcggcccctccgtcttccaaaagcccgtccgcttccaggtggacatcagctcctctgagggtccagagccctccccgcgacgggacggcagcggaggtggtggcatctactccgtcaccttcactctcatctcgggtcccagccgtcggttcaagcgagtggtggagaccatccaggcacagctcctgagcactcatgaccagccctccgtgcaggccctggcagacgagaagaacggggcccagacccggcctgctggtgccccaccccgaagcctgcagcccccacccggccgcccagacccagagctgagcagctctccccgccgaggcccccccaaggacaagaagctcctggccaccaacgggacccctctgccctgaccccacggggccggggagggaggggacccccctccaccccccttccgtgccccccaactgtgaatctgtaaataaggcccaaggaacatgtcgggaggggggtggacacaaaaaccggccttgccctgcagggatggggctccacaggccgtgcccaactgggggtggttctaggggaacagggggcgggggagctgtttctattttatttattgattaatttattattttatttattgatcaatctctctgcggggtggggtgggggagggacgggagctggttggggtggcttagcagatccggacagggccctctgtccctgtgtcgtccccaaccccctcttcccgggcccctcctcccctggtcctccccccacgaccttctgtacggatttgctctccggaaggaattctggtttcgcgtgatcctgcctgcgtccgtgtctctgattccgccggcggcaaaaaaaaaaaaaaaaaaaaaaaaaaaaaa

SEQ ID NO: 356 - protein, 778 aa, Artificial Sequence
  BRSK1
MSSGAKEGGGGSPAYHLPHPHPHPPQHAQYVGPYRLEKTLGKGQTGLVKLGVHCITGQKVAIKIVNREKLSESVLMKVEREIAILKLIEHPHVLKLHDVYENKKYLYLVLEHVSGGELFDYLVKKGRLTPKEARKFFRQIVSALDFCHSYSICHRDLKPENLLLDEKNNIRIADFGMASLQVGDSLLETSCGSPHYACPEVIKGEKYDGRRADMWSCGVILFALLVGALPFDDDNLRQLLEKVKRGVFHMPHFIPPDCQSLLRGMIEVEPEKRLSLEQIQKHPWYLGGKHEPDPCLEPAPGRRVAMRSLPSNGELDPDVLESMASLGCFRDRERLHRELRSEEENQEKMIYYLLLDRKERYPSCEDQDLPPRNDVDPPRKRVDSPMLSRHGKRRPERKSMEVLSITDAGGGGSPVPTRRALEMAQHSQRSRSVSGASTGLSSSPLSSPRSPVFSFSPEPGAGDEARGGGSPTSKTQTLPSRGPRGGGAGEQPPPPSARSTPLPGPPGSPRSSGGTPLHSPLHTPRASPTGTPGTTPPPSPGGGVGGAAWRSRLNSIRNSFLGSPRFHRRKMQVPTAEEMSSLTPESSPELAKRSWFGNFISLDKEEQIFLVLKDKPLSSIKADIVHAFLSIPSLSHSVLSQTSFRAEYKASGGPSVFQKPVRFQVDISSSEGPEPSPRRDGSGGGGIYSVTFTLISGPSRRFKRVVETIQAQLLSTHDQPSVQALADEKNGAQTRPAGAPPRSLQPPPGRPDPELSSSPRRGPPKDKKLLATNGTPLP

SEQ ID NO: 357 - DNA, 1235 bp, Artificial Sequence
  NRGN
gagcgcgggagaccggacccgagagcagagctgctgtttcggcgcgggtcggctggcggccgactgccccagagcccccacccggcaccacacagaccccacccccgccctgcgccagccttcgtccccgcagaggaccccccgacaccagcatggactgctgcaccgagaacgcctgctccaagccggacgacgacattctagacatcccgctggacgatcccggcgccaacgcggccgccgccaaaatccaggcgagttttcggggccacatggcgcggaagaagataaagagcggagagcgcggccggaagggcccgggccctggggggcctggcggagctggggtggcccggggaggcgcgggcggcggccccagcggagactaggccagaactgagcattttcaaagttcccgaggagagatggatgccgcgtccccttcgcagcgacgagacttccctgccgtgtttgtgaccccctcctgcccagcaacctgccagctacaggagccccctgcgtcccagagactccctcacccaggcaggctccgtcgcggagtcgctgagtccgtgcccttttagttagttctgcagtctagtatggtccccatttgcccttccactccaccccaccctaaaccatgcgctcccaatcttccttcttttgcttctcgcccacctcttcccgcacccagcatgcagctctgcctccgcagcctcagtgcgctttcctgcgcgcactgcggagggcgccctaagcgtcacccaagcacactcacttaaagaaaaaacgagttctttcgttctgtgcgcagctaaaaggggcgccctacatctccgtgccactcccgccccagcctagccccaagactttggatccggggcgagatgaagggaagagggttgttttggtttcggacgacccttgctctgaccggaagagaagtccctatcccacacctgcctgtcacgttccctcccctttccccagcgcactgttgagggcagcctctccagctctcttgtttatgcaaacgccgagcgcctgggaggctcggtaggaggagtcttccacggccccgccccgcccctgtcggtcccgccctcccccccgccgggctcctggggctgtggccgaaaggtttctgatctccgtgtgtgcatgtgactgtgctgggttggaatgtgaacaataaagaggaatgtccaagtgaaaaaaaaaaaaaaaaaaaa

SEQ ID NO: 358 - protein, 77 aa, Artificial Sequence
  NRGN
MDCCTENACSKPDDDILDIPLDDPGANAAAAKIQASFRGHMARKKIKSGERGRKGPGPGGPGGAGVARGGAGGGPSG

SEQ ID NO: 359 - DNA, 1188 bp, Artificial Sequence
  TAC1
cacgcaagcgaaaggagaggaggcggctaattaaatattgagcagaaagtcgcgtggggagaatgtcacgtgggtctggaggctcaaggaggctgggataaataccgcaaggcactgagcaggcgaaagagcgcgctcggacctccttcccggcggcagctaccgagagtgcggagcgaccagcgtgcgctcggaggaaccagagaaactcagcaccccgcgggactgtccgtcgcaaaatccaacatgaaaatcctcgtggccttggcagtcttttttcttgtctccactcagctgtttgcagaagaaataggagccaatgatgatctgaattactggtccgactggtacgacagcgaccagatcaaggaggaactgccggagccctttgagcatcttctgcagagaatcgcccggagacccaagcctcagcagttctttggattaatgggcaaacgggatgctgattcctcaattgaaaaacaagtggccctgttaaaggctctttatggacatggccagatctctcacaaaagacataaaacagattcctttgttggactaatgggcaaaagagctttaaattctgtggcttatgaaaggagtgcaatgcagaattatgaaagaagacgttaataaactacctaacattatttattcagcttcatttgtgtcaatgggcaatgacaggtaaattaagacatgcactatgaggaataattatttatttaataacaattgtttggggttgaaaattcaaaaagtgtttatttttcatattgtgccaatatgtattgtaaacatgtgttttaattccaatatgatgactcccttaaaatagaaataagtggttatttctcaacaaagcacagtgttaaatgaaattgtaaaacctgtcaatgatacagtccctaaagaaaaaaaatcattgctttgaagcagttgtgtcagctactgcggaaaaggaaggaaactcctgacagtcttgtgcttttcctatttgttttcatggtgaaaatgtactgagattttggtattacactgtatttgtatctctgaagcatgtttcatgttttgtgactatatagagatgtttttaaaagtttcaatgtgattctaatgtcttcatttcattgtatgatgtgttgtgatagctaacattttaaataaaagaaaaaatatcttgaa

SEQ ID NO: 360 - protein, 129 aa, Artificial Sequence
  TAC1
MKILVALAVFFLVSTQLFAEEIGANDDLNYWSDWYDSDQIKEELPEPFEHLLQRIARRPKPQQFFGLMGKRDADSSIEKQVALLKALYGHGQISHKRHKTDSFVGLMGKRALNSVAYERSAMQNYERRR

SEQ ID NO: 361 - DNA, 3455 bp, Artificial Sequence
  CDH10
acttgcaaatcgctgtgtgctcgcagaagccagcacttccacagtctctaaccttcccatggcgagtgctgcagctctatcagcagaacctttctctccgtgtgaggaagagcttttttcccccctttccttttttttttttttcctttccccttaatcagaagcactgaatgaaagccaatcagagagagctcgcccccgttttcttcggttccctgctgtccagagttaaaagtgatgctgagaaagagcttgagttagattgaagtagaatcagtgatagaaaataacagccgaaaacaaacaaaaaggggacatagtgacaatttctcctgggttattttggctggaaccaacttccattatccagaagctgataaaaaagctttgggaaacatgaacaaaacattgatgaaatgttggaaaccagttgaaacacagtaaaaccaactgggtaaaataggaccacttctcttcatctacactgggatttgtcaagaagtgaactatgacaatacatcaatttttgctactgtttctattctgggtatgcctgccacatttctgctctccagaaataatgttcagaaggacgcctgtgccacagcaaagaattttaagttcacgtgtaccaaggagtgatggcaaaattctccatcgtcaaaaacgtggttggatgtggaatcaatttttcttacttgaagaatatacaggatctgattatcagtacgtaggcaagctacattcagaccaagataaaggagatggatcactcaaatatatcttatctggagatggagctggtactctttttattattgatgaaaaaacaggtgatattcatgccacaaggcgaattgatagggaggaaaaggccttttatactctacgcgcacaagctattaacagaagaactctgaggccagtagagccagagtcagagtttgtgatcaaaattcatgatatcaatgacaatgagccaacgttcccagaagaaatctatacagctagtgttcccgaaatgtctgttgtaggtacttctgtggtgcaagtcacagctacagatgccgatgacccttcatatgggaacagcgccagagtcatttacagcatacttcaagggcagccctatttctctgtggagcctgaaacaggtatcatcaggactgctttaccgaacatgaacagagaaaacagagagcaataccaagtggtcatccaggccaaagacatgggcggccagatgggaggcttatcggggacaaccactgtgaacatcacgctgacagatgtcaatgacaacccaccacgtttcccccagaacactattcatcttcgagttcttgaatcctccccagttggcacagccattggaagtgtcaaagcaactgatgctgacactgggaaaaatgctgaagtagaataccgaattattgatggtgacggtactgatatgtttgacatcgtgactgagaaggacacacaggaaggcatcatcactgtgaaaaagccactcgactatgagagccgaagactttatactctgaaagtcgaagcagaaaacacccatgtagatccccgtttttattacctaggaccatttaaagatactaccatagtgaaaatctctatagaagatgtggatgaacctcctgtttttagtaggtcctcctatctgtttgaagttcatgaagatattgaagtgggcacaatcattggtactgtaatggcaagggacccagattctatttccagccccattagattttccttggatcgccatactgaccttgacagaatctttaacattcattcaggaaatggatctctttatacatcaaaacctcttgaccgtgaactatctcagtggcataatcttactgttattgctgctgaaatcaacaatcccaaagagacaacacgcgtggctgtttttgtgagaattttggatgttaatgacaatgccccacagtttgctgtgttctatgacacttttgtatgtgaaaatgccagaccagggcagctaatacagactataagtgcagtagacaaagatgaccctttaggtggacagaaattttttttcagtttagctgctgtcaatccaaacttcacagtacaggataatgaagataatactgccagaatcttaaccagaaaaaatggattcaatagacatgaaatcagtacctatctcttgcctgtggtgatatcagacaatgattacccaattcagagcagcacaggcacactgaccattcgagtgtgtgcttgtgacagccaaggcaacatgcaatcctgcagtgctgaagccctgctcctccctgccggcctcagcactggggccttgatcgccatcctcctctgcatcatcattctactggttatagtagtactgtttgcagctctgaaaagacagcgaaaaaaagagcctctgatcttgtcaaaagaagatatcagagacaacattgtgagctataacgatgagggtggtggagaggaggacacccaggcctttgatatcggcaccctgaggaatcctgcagccattgaggaaaaaaagctccggcgagatattattccagaaacgttatttattcctcggaggactcctacagctccagataacacggacgtccgggatttcattaatgaaaggctaaaagagcatgatcttgaccccaccgcacccccctacgactcacttgcaacctatgcctatgaaggaaatgattccattgctgaatctctgagttcattagaatcaggtactactgaaggagaccaaaactacgattacctccgagaatggggccctcggtttaataagctagcagaaatgtatggtggtggggaaagtgacaaagactcttaacgtaggatatatgttctgttcaaacaagagaaagtaactctacccatgctgtctccacttcacaatatttgatattcaggagcattttcctgccagtcagcacaattttttttctcatttacttcttaatttgttcattaattacattaattctttcctgtaggatgtctcatggaatatatatgacattttatttaatcacttccaagagccaaagctatggaaatacagtgttgtccatcttagtaaataaaagataatttcagaaacatgaacaggatagttctcccttaagcaacctcacaaacaagccgcttctgttaggtacatgtcctgcccttgcaaatgaagcttttaaaaaggtgaagaaaaattttacagtatatcctgttctgtacattaaattaaaaaaacaaaaatgtacatgtgatgttagtaggtgtgatatgcaacctggtatacagacatttgtgcaatttcatttcatcaaattctatctgctaatgttttatatttatatttttgtatttatttttaaaaaaataaaccagtttttacaactaaaaaaaaaaaaaaaaaa

SEQ ID NO: 362 - protein, 788 aa, Artificial Sequence
  CDH10
MTIHQFLLLFLFWVCLPHFCSPEIMFRRTPVPQQRILSSRVPRSDGKILHRQKRGWMWNQFFLLEEYTGSDYQYVGKLHSDQDKGDGSLKYILSGDGAGTLFIIDEKTGDIHATRRIDREEKAFYTLRAQAINRRTLRPVEPESEFVIKIHDINDNEPTFPEEIYTASVPEMSVVGTSVVQVTATDADDPSYGNSARVIYSILQGQPYFSVEPETGIIRTALPNMNRENREQYQVVIQAKDMGGQMGGLSGTTTVNITLTDVNDNPPRFPQNTIHLRVLESSPVGTAIGSVKATDADTGKNAEVEYRIIDGDGTDMFDIVTEKDTQEGIITVKKPLDYESRRLYTLKVEAENTHVDPRFYYLGPFKDTTIVKISIEDVDEPPVFSRSSYLFEVHEDIEVGTIIGTVMARDPDSISSPIRFSLDRHTDLDRIFNIHSGNGSLYTSKPLDRELSQWHNLTVIAAEINNPKETTRVAVFVRILDVNDNAPQFAVFYDTFVCENARPGQLIQTISAVDKDDPLGGQKFFFSLAAVNPNFTVQDNEDNTARILTRKNGFNRHEISTYLLPVVISDNDYPIQSSTGTLTIRVCACDSQGNMQSCSAEALLLPAGLSTGALIAILLCIIILLVIVVLFAALKRQRKKEPLILSKEDIRDNIVSYNDEGGGEEDTQAFDIGTLRNPAAIEEKKLRRDIIPETLFIPRRTPTAPDNTDVRDFINERLKEHDLDPTAPPYDSLATYAYEGNDSIAESLSSLESGTTEGDQNYDYLREWGPRFNKLAEMYGGGESDKDS

SEQ ID NO: 363 - DNA, 2298 bp, Artificial Sequence
  TPD52L1
cagcttggtttgggccaggtggactggaaggggcggaggtaaccagaagcggctagtggcggctgcctgcgtccccaaccccctccgcgcagcgctcgcgacacgcgtgccaggagtgggagcgagcggcggggccagctgcgttctgagcctgggcgcagctgccatctgctctgggaagcaccagggtgtccccgccgccctcagctcgaagtcagccaccatggaggcgcaggcacaaggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagttactccattcgccattccataagtatgcctgctatgaggaattctcctactttcaaatcatttgaggagagggttgagacaactgtcacaagcctcaagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttgaccatcacatttcagtattcatagatgactgtcacattttaaaatgttcccacttgagcaggtacacaactggtcataattcctgtctgtgtaattcgatgtatatttttccaaacatgtagctattgtttgctttgatttttgcttggcctcctttatgatgtgcatgtccttgaaggctgaatgaacagtccctttcagttcagcagatcaacaggatggagctcttcatgactgtctccagcaataggatgatttactataaatttcatccaactacttgtgatctctctcacctacatcaattatgtatgttaatttcagcaattaaaagaattgattttaatgactttgaattcttaatttctttgtcttaaaagttgctagttatgattttacagatgcaattttaaatcaacttttagccaggtgcggcggctcacacctgtaatcccaactattttggatgccaaggtgagaggattgcttgaggccaggagttaaagatcagcctgggcaacacagaccctgtctctacaaaaaaagaaaaaaattagccagacatagtgttgcttgcctgtagtcccagctactctagaggctgaggcaggaggattgcatgagcctaggagttcgaaactgcagtgagctatgattgcaccactgcactactccagcctgggtgacagagtgggacactgtctccaaaaatagtaataataagtagtcaacttttactgctaatttggtgaacatgagagaggatatgaaaataaatattacctcagctatcctaggatgttaaaataatctccaattttaaaattctctccaatctacatacagtagtagttagtcagataaaggatatccaaaaaagagatagctagaaaatgggagaagcagagttctgcaacccctttcagtttgtaaattgttcacatgtatgaaaataactggtatttatcaatccactcagatttctgcactaacttttatcttatatatcatatgtatctcttttctttttctaaatgggaacatatatttgttattaggtggcagagatatagccttaagatatatttgtaaaatgcacactgaatagacatccaacctaaaaaaaatcactatttaaaaagcccatataatatatacatatttgttagcatgctaattgttcatgttttgtgtttattaaatagaagtgatatatatgacattttgaagtaaagcacatctgaaaaattctactcaaaaaaaaaaaaaaaaaa

SEQ ID NO: 364 - protein, 204 aa, Artificial Sequence
  TPD52L1
MEAQAQGLLETEPLQGTDEDAVASADFSSMLSEEEKEELKAELVQLEDEITTLRQVLSAKERHLVEIKQKLGMNLMNELKQNFSKSWHDMQTTTAYKKTHETLSHAGQKATAAFSNVGTAISKKFGDMSYSIRHSISMPAMRNSPTFKSFEERVETTVTSLKTKVGGTNPNGGSFEEVLSSTAHASAQSLAGGSRRTKEEELQC

SEQ ID NO: 365 - DNA, 2223 bp, Artificial Sequence
  HIST2H2BE
acttcttttcttggctaagccgcgtttgtactgtgtcttaccatgcctgaaccggcaaaatccgctccggcccctaaaaagggctccaagaaagccgtcaccaaagcccagaagaaagacggcaagaagcgcaagcgcagccgcaaagagagctactccatctacgtgtacaaggtgctgaagcaggtccaccccgacaccggcatctcgtccaaggccatgggcatcatgaactccttcgtcaacgacatcttcgagcgcatcgcgggagaggcttcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctccaagtgagtccctgccgggacctggcgctcgctcgctcgagtcgccggctgcttgactccaaaggctcttttcagagccacccacctaatcactagaaaagagcttgttcacttattcccttagtttcttttcataaagtaagttattttagtgtgaaggtcatgggaaatggcatacgtagctttttaactatttggaactcgaggtccccagtgcgtcattggatttgcttttgaatctagagcgtgtctttactcattgtgctgcttagccttcccaggagtcggttctcaattaggctgttgggaatccgcctctttacccgcccccactcccgccccacacgcgccctggtggctccttgggtctgtttcattctaaaacgaagtggctgagttcggctgtcatttaagagaactccaggacacaattcagcccgggttccgcaaacactgcgtgacagctctgtatgactgacgcttggcagcagcttttgtgtccggtcaccagttctgccgtgcgatggggcctcctgtggataccagccgttctgtgtattttggacgaaggccgcgcagccgggtcccagccttgtcctgattgggcgacaagaatattcaaaattctgcgcctttttctaatttgtagatttcagtttccgtcgttcactttgagactttgaaattcctatttctcattttgttgataatttctgcatttaatggtctgtgctttaaatggtaacgctacggccccaggtcactgcgaggcacttaccatgtagatacgggctcaaaagtcacctctcagagacctacgtcatccactcaggaattcgcgcctctcatacttgcctgtctcattttatcttccttctagcagctgtctgaaattggttcgtctgttttcttgtttatggtattctcaagcccttgacagaccggctagtgtggttttcccgtgcatcttcagcctggcacattatggacacttaaatactacgtattgatctaatattgttgggttaatttttccatcccacccttttcttaatcgcttccgtggatggatgaagggtgctgttcatttccattagatgtatgtgaaggcacagtgaaaatggaaatgttcttggagctacttcctcaaaatgtatccttagtcacctcagtgcaacagctgggagggggccgtgttaagattttttttgctacaaagaggaggtggcaatggtagatccacccttatgcttctcagtttagcataacctcttatggattttcatcaaattcagcgtgttggtcactggaaagagccttttccttctccttttcttactctcccctcatggtgttcccctcttaaaggagaggagcttttaatttacacttaccacctcatttgcttttctggaggccatgcaatataggcgggactacagagttaatctcctttttacaaatgaggccaagagaagcctcattggttcacagtcatgcagctcatactgtccacccttgtattctcagatgcaggacaattgcattttagttttattttgtggaggtgcagaatatttactctttctgtccaacccttgattctgccgaggaagacactgatggtttgatgagtgattcagctgtttttggctaagggcttttggagctgatggcaggggtttgatgaatccaaatgagctctagacattatcacagactgaatagatcttaactgtctcctacatgtgtgttttcaaatgtgtatagatgctattgttattaataaagttaccaattaatttaa

SEQ ID NO: 366 - protein, 126 aa, Artificial Sequence
  HIST2H2BE
MPEPAKSAPAPKKGSKKAVTKAQKKDGKKRKRSRKESYSIYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 367 - DNA, 4001 bp, Artificial Sequence
  SLC16A9
ctcctccttcccccaaccacccgcgcagtcacaaccggttcagactggccggggtgccccgcaaagagagacaagggagaaaaagacagcagggaaaaccccggggaggagaaggcgaaagagaaggtggagctcagagaagggggccggctccccagctccatgtggccgccgccgctgcgggtctgtgggggcagagggcggcggctcccggggcagcgcgtagcgggaccgattgcctaatactccggcaggggccggggccgcagctggctcggataaatagccgcccggctggcccggagctgcaggggagagcggcggccgcgatccccaccacaccaccagcccggccgcacggggcactgagccgggtgctgagcaccggaggccccgccgaggccgggactcaggacctgcagagaaacgcctcctgattttgtcttacaatggaacttaaaaagtcgcctgacggtggatggggctgggtgattgtgtttgtctccttccttactcagtttttgtgttacggatccccactagctgttggagtcctgtacatagaatggctggatgcctttggtgaaggaaaaggaaaaacagcctgggttggatccctggcaagtggagttggcttgcttgcaagtcctgtctgcagtctctgtgtctcatcttttggagcaagacctgtcacaatcttcagtggcttcatggtggctggaggcctgatgttgagcagttttgctcccaatatctactttctgtttttttcctatggcattgttgtaggtcttggatgtggtttattatacactgcaacagtgaccattacgtgccagtattttgacgatcgccgaggcctagcgcttggcctgatttcaacaggttcaagcgttggccttttcatatatgctgctctgcagaggatgctggttgagttctatggactggatggatgcttgctgattgtgggtgctttagctttaaatatattagcctgtggcagtctgatgagacccctccaatcttctgattgtcctttgcctaaaaaaatagctccagaagatctaccagataaatactccatttacaatgaaaaaggaaagaatctggaagaaaacataaacattcttgacaagagctacagtagtgaggaaaaatgcaggatcacgttagccaatggtgactggaaacaagacagcctacttcataaaaaccccacagtgacacacacaaaagagcctgaaacgtacaaaaagaaagttgcagaacagacatatttttgcaaacagcttgccaagaggaagtggcagttatataaaaactactgtggtgaaactgtggctctttttaaaaacaaagtattttcagcccttttcattgctatcttactctttgacatcggagggtttccaccttcattacttatggaagatgtagcaagaagttcaaacgtgaaagaagaagagtttattatgccacttatttccattataggcattatgacagcagttggtaaactgcttttagggatactggctgacttcaagtggattaataccttgtatctttatgttgctaccttaatcatcatgggcctagccttgtgtgcaattccatttgccaaaagctatgtcacattggcgttgctttctgggatcctagggtttcttactggtaattggtccatctttccatatgtgaccacgaagactgtgggaattgaaaaattagcccatgcctatgggatattaatgttctttgctggacttggaaatagcctaggaccacccatcgttggttggttttatgactggacccagacctatgatattgcattttattttagtggcttctgcgtcctgctgggaggttttattctgctgctggcagccttgccctcttgggatacatgcaacaagcaactccccaagccagctccaacaactttcttgtacaaagttgcctctaatgtttagaagaatattggaagacactatttttgctattttataccatatagcaacgatattttaacagattctcaagcaaattttctagagtcaagactattttctcatagcaaaatttcacaatgactgactctgaatgaattatttttttttatatatcctattttttatgtagtgtatgcgtagcctctatctcgtatttttttctatttctcctccccacaccatcaatgggactattctgttttgctgttattcactagttcttaacattgtaaaaagtttgaccagcctcagaaggctttctctgtgtaaagaagtataatttctctgccgactccatttaatccactgcaaggcacctagagagactgctcctattttaaaagtgatgcaagcatcatgataagatatgtgtgaagcccactaggaaataaatcattctcttctctatgtttgacttgctagtaaacagaagacttcaagccagccaggaaattaaagtggcgactaaaacagccttaagaattgcagtggagcaaattggtcattttttaaaaaaatatattttaacctacagtcaccagttttcattattctatttacctcactgaagtactcgcatgttgtttggtacccactgagcaactgtttcagttcctaaggtatttgctgagatgtgggtgaactccaaatggagaagtagtcactgtagactttcttcatggttgaccactccaaccttgctcacttttgcttcttggccatccactcagctgatgtttcctgggaagtgctaattttacctgtttccaaattggaaacacatttctcaatcattccgttctggcaaatgggaaacatccatttgctttgggcacagtggggatgggctgcaagttcttgcatatcctcccagtgaagcatttatttgctactatcagattttaccactatcaaatataattcaagggcagaattaaacgtgagtgtgtgtgtgtgtgtgtgtgtgtgctatgcatgctctaagtctgcatgggatatgggaatggaaaagggcaataagaaattaatacccttatgcagttgcatttaaccttaagaaaaatgtccttgggataaactccaatgtttaatacattgattttttttctaaagaaatgggttttaaactttggtatgcatcagaattccctatagatctttttgaaaatataggtacctgggtatcacacatagaacttttaattctgctggtgtaggctgttgcccaaacatctataattttactgagctcttcaagtgattctgataacacagcctggattgagaatttttataagattggcaatggaaaaacatttattcttttaaataataatttttttaaaacccaagaggtcaggggattttataaaccaatagccaagtgttctttaaataggaggcacccttcccattgtgccaaaatcatcttttcatttattttgaaatttgtatgattattttatacttgtatgttgcctttcttcgaaggcgcctgaagcactttataaacacaaatcctcacaatacctctgtgaggtaggtaaatagtacttttctatgtagtaaacctggaatatggagaatttcataacagttcattctacttaataatgcaataatggagctccaagttgtcttggacttctacaccacactcagacttctggaaagttttctgtacctcattctttagtccctgtcaaggttagtaaataaaataagtgacataaaaaaaaaaaaaactaaactacttgttgtgttgaaagttcctttttgccagttatgttcaggaaacccaataacctgaaaaagtttgactttgatgtgacatcttcatattcatcaatgctgataattgtccaaaggcatcttcactatgtctgctaaataacatccaatgtgggcgttatctgttgtctaggggatgaattttaagttacaataaaatatttttctttgttttgcaaaaaaaaaaaaaaa

SEQ ID NO: 368 - protein, 509 aa, Artificial Sequence
  SLC16A9
MELKKSPDGGWGWVIVFVSFLTQFLCYGSPLAVGVLYIEWLDAFGEGKGKTAWVGSLASGVGLLASPVCSLCVSSFGARPVTIFSGFMVAGGLMLSSFAPNIYFLFFSYGIVVGLGCGLLYTATVTITCQYFDDRRGLALGLISTGSSVGLFIYAALQRMLVEFYGLDGCLLIVGALALNILACGSLMRPLQSSDCPLPKKIAPEDLPDKYSIYNEKGKNLEENINILDKSYSSEEKCRITLANGDWKQDSLLHKNPTVTHTKEPETYKKKVAEQTYFCKQLAKRKWQLYKNYCGETVALFKNKVFSALFIAILLFDIGGFPPSLLMEDVARSSNVKEEEFIMPLISIIGIMTAVGKLLLGILADFKWINTLYLYVATLIIMGLALCAIPFAKSYVTLALLSGILGFLTGNWSIFPYVTTKTVGIEKLAHAYGILMFFAGLGNSLGPPIVGWFYDWTQTYDIAFYFSGFCVLLGGFILLLAALPSWDTCNKQLPKPAPTTFLYKVASNV

SEQ ID NO: 369 - DNA, 7689 bp, Artificial Sequence
  MEGF10
acccgcccccaccccctccagcatctcgggccagacagagaaaaccttgttcaagtttgcagcaagtactttcccggtgcgcaaaactgggcgactgggaacgcgttgagacgttcctctttcccgcttctccacctttacgcctgaaagaagactcccaaagattgctttcttctgggacgctgcttggacgctaaccgcgttgattggaacagattttgtgtcttggctggctttgggtgaagaccggggagaaaaggttgcgctgcgattctcaagatctctggacctggattatcattgcaaatccattaaagaaggagaagcaagcggatttcagagaggttgttcttcagaaaaaaatggttatttctttgaactcatgcctgagctttatttgtttattgttatgccactggattgggacagcatcacctctgaatcttgaagaccctaatgtgtgtagccactgggaaagctactcagtgactgtgcaagagtcatacccacatccctttgatcaaatttactacacgagctgcactgacattctaaactggtttaaatgcacgcggcacagagtcagctatcggacagcctatcgacatggggagaagactatgtataggcgcaagtctcagtgttgtcctggattttatgaaagcggggaaatgtgtgtcccccactgtgctgataaatgtgtccatggtcgctgtattgctccaaacacctgtcagtgtgagcctggctggggagggaccaactgctccagtgcctgcgatggtgatcactggggtccccactgcaccagccggtgccagtgcaaaaatggggctctgtgcaaccccatcaccggggcttgccactgtgctgcgggcttccggggctggcgctgcgaggaccgctgtgagcagggcacctatggtaacgactgtcatcagagatgccagtgccagaatggagccacctgcgaccacgtcacgggggaatgccgctgcccaccaggatacaccggagccttctgtgaggatctttgtcctcctggtaaacatggtccacagtgtgagcagagatgcccttgtcaaaatggaggagtgtgtcatcacgtcactggagaatgctcttgcccttctggctggatgggcacagtgtgtggtcagccttgccccgagggtcgctttggaaagaactgttcccaagaatgccagtgccataatggagggacgtgtgatgctgccacaggccaatgtcattgcagtccaggatacacaggggaacggtgccaggatgagtgtcctgttgggacctatggcgttctctgtgctgagacctgccagtgtgtcaacggagggaagtgttaccacgtgagcggcgcatgcctctgtgaagcaggctttgctggcgagcgctgcgaagcacgcctgtgtcctgaggggctctacggcatcaaatgtgacaaacggtgtccctgccacctggaaaacactcatagctgtcaccccatgtctggagagtgtgcctgcaagccgggctggtcaggactctactgtaatgagacatgttctcctggattctacggggaagcttgccagcagatctgcagctgccaaaatggggcagactgtgacagtgtgactggaaagtgcacctgtgccccaggattcaaaggaattgactgctctaccccatgccctctgggaacctatgggataaactgttcctctcgctgtggctgtaaaaatgatgcagtctgctctcctgtggacgggtcttgtacttgcaaggcaggctggcacggggtggactgctccatcagatgtcccagtggcacatggggctttggctgtaacttaacatgccagtgcctcaacgggggagcctgcaacaccctggacgggacctgcacgtgtgcacctggatggcgcggggagaaatgcgaacttccctgccaggatggcacgtacgggctgaactgtgctgagcgctgcgactgcagccacgcagatggctgccaccctaccacgggccattgccgctgcctccccggatggtcaggtgtccactgtgacagcgtgtgtgctgagggacgctggggccccaactgctccctgccctgctactgtaaaaatggggcttcatgctcccctgatgatggcatctgcgagtgtgcaccaggcttccgaggcaccacttgtcagaggatctgctcccctggtttttatgggcatcgctgcagccagacatgcccacagtgcgttcacagcagcgggccctgccaccacatcaccggcctgtgtgactgcttgcctggcttcacaggcgccctctgcaatgaagtgtgtcccagtggcagatttgggaaaaactgtgcaggaatttgtacctgcaccaacaacggaacctgtaaccccattgacagatcttgtcagtgttaccccggttggattggcagtgactgctctcaaccatgtccacctgcccactggggcccaaactgcatccacacgtgcaactgccataatggagctttctgcagcgcctacgatggggaatgtaaatgcactcctggctggacagggctctactgcactcagagatgtcctctagggttttatggaaaagattgtgcactgatatgccaatgtcaaaacggagctgactgcgaccacatttctgggcagtgtacttgccgcactggattcatgggacggcactgtgagcagaagtgcccttcaggaacatatggctatggctgtcgccagatatgtgattgtctgaacaactccacctgcgaccacatcactgggacctgttactgcagccccggatggaagggagcgagatgtgatcaagctggtgttatcatagttggaaatctgaacagcttaagccgaaccagtactgctctccctgctgattcctaccagatcggggccattgcaggcatcatcattcttgtcctagttgttctcttcctactggcattgttcattatttatagacacaagcagaagggaaaggaatcaagcatgccagcagttacctacacccctgctatgagggtcgtcaatgcagattataccatttcaggaacccttcctcacagcaatggtggaaacgctaatagccactacttcaccaatcccagttaccacacgctcacccagtgtgccacatcccctcacgtcaacaacagggacaggatgactgtcacgaagtcaaaaaacaatcaactgtttgtgaatcttaaaaatgtgaaccctgggaagagaggccctgtgggggactgcactgggacattgccggctgactggaaacatggcggctacctcaacgagctcggtgcttttggacttgacagaagctatatgggaaaatccttaaaagacctgggaaagaattctgaatataattcaagtaactgctccctaagcagttctgagaacccatatgccactattaaagacccacctgtacttatcccgaaaagctcagagtgtggttatgtggagatgaaatcgccggcacgaagagattccccatatgcagagatcaataactcaacttcagccaacaggaatgtctatgaagttgaacctacagtgagtgttgtccaaggagtattcagcaataatgggcgtctctcccaggatccatatgacctcccaaagaacagtcacatcccttgtcattatgacctgctgccagtccgagacagttcatcctcccctaagcaagaggacagtggtggtagcagcagcaacagcagcagcagcagtgaatgacaccaaaggaccgcttggtagccactggaaccctttccagaactgctgtttggttcttctccatcctcaattttgccactttcatgtgaatgttagtcaattcggtgggcaatttttggacatgaaccagaaagctgaaagctgaggctgacacggactgtaggtgctttttgttcaggtggattcgaaggagttagagatgtgatttcccattgctgttagttttagaactatacccgtgaagcatgacttattgtaagatgttggctgaaagcatgaacttgcagaactccctcggagacgcaggttgcagtggacattgggattgttgcttgaaaaattaaaatttgaatattttctctctcatttgcatcatacagctctacctaggattgtacagtttaccataaaatttacttcatgaaagtgggaatcactgaacatgtagaagacaaggaacatattgttaactcctgattcttaactttattcaactggactcagaattgtagggataatatgaatgcaggaggaaacattctgtcaggcggtatgactggacagactttgaatatactctaaaagtggacagaaaatttacgaaaatcttagattttgtttagaatgagaaaatatacaattagaattattttagaaatagtaggaagtattgcagaagtcaatacacaaatgtgccaggcagaggtggttttctctgtttgactctcaaccaacttcagatctatgacattattctgatcactggctccatcatacatattcaccacttgagattcataacatatcaatagttatttcataaatatagaaatgaaataattttatttttgacagactggatggaatgagtgtgtaatgattgataaaggttgtaaattttaaatgcaagatgacgcttacgttctgtaaaccattagtaatacatgctgtaatatagaattagtggaacattttgattaatctttccctagaagtgactgaaatatttttgtgcatatttgagaaagggaactttccttttattaattgtcaatttagagaaactatgcttaagctggtcttttgcattgctaatgtgacatgtacccaacttttcattaatttgtatttccatttttaaattgcatattctatgttttgtagtgtttggattgttaatgaaaaaatattatatgttcgttattccttgtattattgccacttatcttttgcttgataaaaatgcgttgttcttttttcttttggagggacaagatgaaaatatataatttgaattgattaaaattggtcgttactaaaatagtatagtaaccacaagtgattggcttataaatgaagtagaaatgctttttaatattccaaaatagagttccttttgatctgttggtgctgagccttggttaaaccagggagaaggggagcagaaaggaaacgttgttactgatgagtaccacagactcatcttaaaaaaaactctcattatggtgatcatagaattgaccatccaaactgggacactcttgagagtaaatggagggcattattaataattatcttgtaatgaacttaaatctggactgttccaggcaaaccagacttatcttgcaatatgagaatgctgacacaatgcaggaaagccagtttcccttttgttgatctacttgaccaagcaaaggggctgaaaaactgaataaggaaacaactttataagagaaacagtggtcttcaatcttttaaagacatgaaatcctatatggcattctgtctcagtgagtcagttaacaaatacgtatgtgcaacccttctgctagtagtgcacataagtgattatccctgccaggtatcgagttggaatatccagttatttcatgtcacacatcggcacgtatgatggtggtttggtcagatggataatacagcagacacacttagaacactcactgcactggtggctgttcattttgaggaactccaaagtcaattcaaggaaataaggaatgacctggaacaggccttagaaacaattgatttattccaatagttaaccactggctggctcccaactctaggtgataggcatctaattgagacatgtgtgagtcaatagccatcggggtcctttttggtgagaagaaataagacattttctcccttttaaagatcatctcttcagagctgcatggtaaatttgaatttccccattgttctctagagctaggtcaaaaaaacaactgtttcttttcttattccactattaataaattgaaagcttgctgtacaaaggcaacagcaacttaaaaaagaaaatctggacaatagatgtggactccaaggggccactgccatcccttcctgtgtgctctttttgacaagtaaatcactccagttagctgatgtcctgaaatgacatttgtacctgaggcaattcttattagagcttactcaggacttttcaaacatcaggacacacatagcaatttggatgttgtaaaactacgtgttacatttggagaggtcttgttgagaaggcaaaattttctaaatattttgatatcaatttgggtaaagaaaggaatacttttgttagaatgagaattaaagagaaaacaaaagaatcttggcaaaattttccctctgaaattacaaactttaggaacttttccagatgtatcgaatttaatttgacattgatgtcactcttcataccaagtgaatctattctcatgaactttgaacccatgttaattttggaccctataactaatttcctttctgtatcccatggtggtcaaagcagtaaaggagtttagagatacttagcaaatgccattcatatagtattgttagccaaactattattccttccttagaagttgatgtatcagaaaatttataagttatttgtatttatatataagtacatcagaacttgcccacatgataactcatgtttgctttaataaggaaaatatgttatttgaggttaattatatgatagtgaggaacattttacaattatttacagtgtttgacattaattgctgtcctatgatacagtagtaatgttaacagagagtttaatatgtttagcattatctttatggaatttatattcaccaatttcaggaaaaccaaccatagaactttataataggacagttataacctgactgaaccaaatccatcagcataatgactgtgtgttctgagaaatgcaaacaactttatgaaagtgtggtcatcttgacccccaaagagccacagtagctgtcaattattgagatttttaaatggtaaatattgcaaaagttaaacaagggtaccacaatatcatttataattgatgtcaatattagtagtccactttatgcttaaaataaaatcataaaaaatcaagttttaaggttatattttttaaaataatgaattttctatctctaggcaacatgtctttattattcaagctgaatgtttaagagagattttggtcttaaaggcttcacatcatgaaagtgtacatgcatatgcaagtgtgaattacgtggtatggatgtttgcttgtttattaactaaagatgtacagcaaactgcccgtttagagtcctgttaatattgatgtcctaacactgggtctgcttatgctagttcagtatttggtctaggcttcattttgatatgactgaattgcaatctatatttttaaaaagaaaaatcaaaatacattagggtttacttggttgtggcaaacaaacaaaaaatgctttcagtgttgaaatatctctattttccaaagatgataaactttcatcgttcttagcctacattgtcatttatatcaccaaatgagtttatagattaatgcaataaactttctaataaaaaa

SEQ ID NO: 370 - protein, 1140 aa, Artificial Sequence
  MEGF10
MVISLNSCLSFICLLLCHWIGTASPLNLEDPNVCSHWESYSVTVQESYPHPFDQIYYTSCTDILNWFKCTRHRVSYRTAYRHGEKTMYRRKSQCCPGFYESGEMCVPHCADKCVHGRCIAPNTCQCEPGWGGTNCSSACDGDHWGPHCTSRCQCKNGALCNPITGACHCAAGFRGWRCEDRCEQGTYGNDCHQRCQCQNGATCDHVTGECRCPPGYTGAFCEDLCPPGKHGPQCEQRCPCQNGGVCHHVTGECSCPSGWMGTVCGQPCPEGRFGKNCSQECQCHNGGTCDAATGQCHCSPGYTGERCQDECPVGTYGVLCAETCQCVNGGKCYHVSGACLCEAGFAGERCEARLCPEGLYGIKCDKRCPCHLENTHSCHPMSGECACKPGWSGLYCNETCSPGFYGEACQQICSCQNGADCDSVTGKCTCAPGFKGIDCSTPCPLGTYGINCSSRCGCKNDAVCSPVDGSCTCKAGWHGVDCSIRCPSGTWGFGCNLTCQCLNGGACNTLDGTCTCAPGWRGEKCELPCQDGTYGLNCAERCDCSHADGCHPTTGHCRCLPGWSGVHCDSVCAEGRWGPNCSLPCYCKNGASCSPDDGICECAPGFRGTTCQRICSPGFYGHRCSQTCPQCVHSSGPCHHITGLCDCLPGFTGALCNEVCPSGRFGKNCAGICTCTNNGTCNPIDRSCQCYPGWIGSDCSQPCPPAHWGPNCIHTCNCHNGAFCSAYDGECKCTPGWTGLYCTQRCPLGFYGKDCALICQCQNGADCDHISGQCTCRTGFMGRHCEQKCPSGTYGYGCRQICDCLNNSTCDHITGTCYCSPGWKGARCDQAGVIIVGNLNSLSRTSTALPADSYQIGAIAGIIILVLVVLFLLALFIIYRHKQKGKESSMPAVTYTPAMRVVNADYTISGTLPHSNGGNANSHYFTNPSYHTLTQCATSPHVNNRDRMTVTKSKNNQLFVNLKNVNPGKRGPVGDCTGTLPADWKHGGYLNELGAFGLDRSYMGKSLKDLGKNSEYNSSNCSLSSSENPYATIKDPPVLIPKSSECGYVEMKSPARRDSPYAEINNSTSANRNVYEVEPTVSVVQGVFSNNGRLSQDPYDLPKNSHIPCHYDLLPVRDSSSSPKQEDSGGSSSNSSSSSE

SEQ ID NO: 371 - DNA, 5575 bp, Artificial Sequence
  FMNL2
gcggccgcgggcccggcagaaggccgagtaggagggaccacgcgccgggggccgcgatctctggcagggggcggtgtgccagcggagcaccatgcacataggcgcccagcgccccaactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaatgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgccgccgccgccccctcctccacctcctcctcccccaccgccccctccgcctcctcctctcccaggccctgcagctgagactgtaccagctcctcccttagcacctccccttccctctgcacctccgctgcctggaacatcttcacccacagtggttttcaactcaggattagcagctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgcgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactactattctgtaa

SEQ ID NO: 372 - protein, 1092 aa, Artificial Sequence
  FMNL2
MGNAGSMDSQQTDFRAHNVPLKLPMPEPGELEERFAIVLNAMNLPPDKARLLRQYDNEKKWELICDQERFQVKNPPHTYIQKLKGYLDPAVTRKKFRRRVQESTQVLRELEISLRTNHIGWVREFLNEENKGLDVLVEYLSFAQYAVTFDFESVESTVESSVDKSKPWSRSIEDLHRGSNLPSPVGNSVSRSGRHSALRYNTLPSRRTLKNSRLVSKKDDVHVCIMCLRAIMNYQYGFNMVMSHPHAVNEIALSLNNKNPRTKALVLELLAAVCLVRGGHEIILSAFDNFKEVCGEKQRFEKLMEHFRNEDNNIDFMVASMQFINIVVHSVEDMNFRVHLQYEFTKLGLDEYLDKLKHTESDKLQVQIQAYLDNVFDVGALLEDAETKNAALERVEELEENISHLSEKLQDTENEAMSKIVELEKQLMQRNKELDVVREIYKDANTQVHTLRKMVKEKEEAIQRQSTLEKKIHELEKQGTIKIQKKGDGDIAILPVVASGTLSMGSEVVAGNSVGPTMGAASSGPLPPPPPPLPPSSDTPETVQNGPVTPPMPPPPPPPPPPPPPPPPPPPPPLPGPAAETVPAPPLAPPLPSAPPLPGTSSPTVVFNSGLAAVKIKKPIKTKFRMPVFNWVALKPNQINGTVFNEIDDERILEDLNVDEFEEIFKTKAQGPAIDLSSSKQKIPQKGSNKVTLLEANRAKNLAITLRKAGKTADEICKAIHVFDLKTLPVDFVECLMRFLPTENEVKVLRLYERERKPLENLSDEDRFMMQFSKIERLMQKMTIMAFIGNFAESIQMLTPQLHAIIAASVSIKSSQKLKKILEIILALGNYMNSSKRGAVYGFKLQSLDLLLDTKSTDRKQTLLHYISNVVKEKYHQVSLFYNELHYVEKAAAVSLENVLLDVKELQRGMDLTKREYTMHDHNTLLKEFILNNEGKLKKLQDDAKIAQDAFDDVVKYFGENPKTTPPSVFFPVFVRFVKAYKQAEEENELRKKQEQALMEKLLEQEALMEQQDPKSPSHKSKRQQQELIAELRRRQVKDNRHVYEGKDGAIEDIITDLRNQPYRRADAVRRSVRRRFDDQNLRSVNGAEITM

SEQ ID NO: 373 - DNA, 5361 bp, Artificial Sequence
  KIAA1598
attgcgtcccgctctacctctgtggttctttgggagcgacccccgggaagcgtccaaagtggagttcccacacacgctgcgaacccacagccggttttctctgaactcgcgtccctgagtccgggaggtggaggcggagaaaagggtgcggagcgaccccacgcagggccgccccccctcccaccagcgcgtcctgccgcgccggcagccacaggctggcatagcggctgccgacccgccctcgttcctccaccccctgaacgggactgctgggcccgccccgccccgcctgcaggtgaagcggccgcagccgccgagtaggtgcgtggggatgatctcactcgcgcgctccgcgccaggaggaggaggagcgggagcggatccaacttccgggtagtggagccgcaagccaccggcatcttgctttttcttccccctcctcctgtgtgccccgcgccgctccctctttcccttttattcccggccccacccgccaaaatgaacagctcggacgaagagaagcagctgcagctcattaccagtctgaaggagcaagcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcagcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaacgtgagagagacagacagctccaactgctgatccataaaccagaagcctgacatgtttggaagtccttttcaataagcacatgattagtgttgttatattggcaagggctgtagacattctgctctggtcactgtattcagaatacaggttcttttctggtgtcacttttgtaagtagcaactataaacataagtaagctgtttagcaaaacacacattcctagtaggttttggttttttgatctttataaagatgaggtttttttcctagttactgtattaagtatgacttcttttagaaggttacaaaaaaattcagatgttgatacctttttaggaaatgtgcataccactcatcaaatggaatgctgaaagtttgaggtgcttgtatataatcggataaacaaaactgatcaacccaatgtgattttaaaagcccccaaagaagcttctgttttgggtctgatcctcttgatggagaaactgcagcagcatggaaattgttgggtactgtggcatacaagttattttctacagtagactgagataaactgaaaactcaggagctggcatcaaactcgtagtcccatagtcagtgttaattacacacattgttaactattggatgaaaaatacatgctattgattgtgtccaaagcctcccgaggacctccgtggggatgctctggtagcctgaatacagaactgaggtgaaagtccaaaccttgaattttacagtagtaagttggtaaaccatgtgctctgtgctatgagttaattatgttttcccaaatactaatgtggcacaagtaccatattttatcagagttcttatgtacagtatggtgaagataagtgacaagcacacatttttcttgcttcactgctgttctatattacacaggtttgttgttgttttttttaaaaaagaaattaagcagtagttagtctctaaaaatacaatgtttcaggctaccacagtgaataaatagaaatgtaatcagggattaaaaaaaaaacttatgcagcttttcaaagttgattgtttcaaaattggtgtttatttaaaataagtggtaatgtacttgaatgcactttttatgacaatgattcagtaatggtaattttactattaaagaaagtgaaaggtttagttttgttagcatggctcagcatgtagctgtcaggtgtttttcacctaagggcaaaagaaaatgatagtaataattgcagtagttgtattgtattgtatttttgcacgtgtggtaagcataggcttgaagaggtgggtaggcaggtacatgtacttcctaaatttggagataattatctttctgtaagttcgttatgcttgactgtttccatgttctcccaataatgattttatagttacttatcactttactcatggagaattaaaacgtaatgtttttcaactgtatctttctttaactggataatactgctatatgatatgcttactacagactgcattaattcacgaaacgaattctgttatgctgtaatttgaactctcctcaccacaacttattaaaaaggcaccaatagtttcccattaagggtcagttgtggttattattaacgtttctggtttagttccccaagcttgacattctttaatagaaaattgtatatgatttgacaactttagtaatttttaatagtccctaagatggtttattgagttttctttcatgtttctttgtgctgtcttccttcttgcatctgtgatctgtctgccagcatgcaactcacacacatttaggaatataaaaatatgtacactgtctttccatatttcatcacaccatcacagaataatatggttatcaaaataccctcctttctagagtaagaagttgccctttgggtgaaatgtgttagctggactagggaacaattagtaacaggtattttgaaagtattcctgccttttttaagctgcttactttctctcactgtgattacaaagcattttaaattaatttgacatgaaggtatttgatggaagatattcactcacctttttctgcctacagtttttcccttttcactttggttttgagggggttttgcccctggctggggtgacactgtcaaccaaagcaagggatcccaaataggaagacataggagaaccgtgcttatatctgcaaggtatgttcatagctattgcacacacaaaacttacatacgtcctgcttacacaattttaagttggaaaagactgcatctttatgtttttgatttctctaaaaggttatttatgcttccttctgtttgggaaagataaattaagtcttgtgcgctatagaggattttttttctttaagaaaaacgaatgttgatgcattttatagcccgagtgaggaacagagatagaggtactttgtgccattgctattaaagaaaaagaaaatgtctctttttttttctggaagaataagattttaattaaagcacttgcacccttttgtatgtgagctggtctcaaacaaagtcctcacccacagcagtttcagcagctgaacagtcccatggaagttctgactggcaggcatcaacagggctattagcacccagcatagtttgccctgagtacggaggatggatgctttggctctaactactcaccaataattgctccttccttaccttctttgttaatggtaaactgctggaaatggagtagtacaggtaacaattatttttaattgtctttccagaccagtttttggttgtgtgttcagtaaatgatagtctgtatcacagccttcaagtctggattatttttctaaatgcatactctacctgttcagttacactcgttgtggaacaacattagcttatataccagtaagttgtcgagaatggataaccatctgtcattatcactgaccttcaaagactcatcaagcagtccctgcataaggattggagtggtttgaagtttctcttccaagcactaacatgtccc

SEQ ID NO: 374 - protein, 631 aa, Artificial Sequence
  KIAA1598
MNSSDEEKQLQLITSLKEQAIGEYEDLRAENQKTKEKCDKIRQERDEAVKKLEEFQKISHMVIEEVNFMQNHLEIEKTCRESAEALATKLNKENKTLKRISMLYMAKLGPDVITEEINIDDEDSTTDTDGAAETCVSVQCQKQIKELRDQIVSVQEEKKILAIELENLKSKLVEVIEEVNKVKQEKTVLNSEVLEQRKVLEKCNRVSMLAVEEYEEMQVNLELEKDLRKKAESFAQEMFIEQNKLKRQSHLLLQSSIPDQQLLKALDENAKLTQQLEEERIQHQQKVKELEEQLENETLHKEIHNLKQQLELLEEDKKELELKYQNSEEKARNLKHSVDELQKRVNQSENSVPPPPPPPPPLPPPPPNPIRSLMSMIRKRSHPSGSGAKKEKATQPETTEEVTDLKRQAVEEMMDRIKKGVHLRPVNQTARPKTKPESSKGCESAVDELKGILGTLNKSTSSRSLKSLDPENSETELERILRRRKVTAEADSSSPTGILATSESKSMPVLGSVSSVTKTALNKKTLEAEFNSPSPPTPEPGEGPRKLEGCTSSKVTFQPPSSIGCRKKYIDGEKQAEPVVVLDPVSTHEPQTKDQVAEKDPTQHKEDEGEIQPENKEDSIENVRETDSSNC

SEQ ID NO: 375 - DNA, 3272 bp, Artificial Sequence
  DNER
aaccgcggatcccgcagctgcaggaggcgcccggcccggcggagcagccctagccgccaccgtcgctctcgcagctctcgtcgccactgccaccgccgccgccgtcactgcgtcctggctccggctcccgcgccctcccggccggccatgcagccccgccgcgcccaggcgcccggtgcgcagctgctgcccgcgctggccctgctgctgctgctgctcggagcggggccccgaggcagctccctggccaacccggtgcccgccgcgcccctgtctgcgcccgggccgtgcgccgcgcagccctgccggaatgggggtgtgtgcacctcgcgccctgagccggacccgcagcacccggcccccgccggcgagcctggctacagctgcacctgccccgccgggatctccggcgccaactgccagcttgttgcagatccttgtgccagcaacccttgtcaccatggcaactgcagcagcagcagcagcagcagcagcgatggctacctctgcatttgcaatgaaggctatgaaggtcccaactgtgaacaggcacttcccagtctcccagccactggctggaccgaatccatggcaccccgacagcttcagcctgttcctgctactcaggagcctgacaaaatcctgcctcgctctcaggcaacggtgacactgcctacctggcagccgaaaacagggcagaaagttgtagaaatgaaatgggatcaagtggaggtgatcccagatattgcctgtgggaatgccagttctaacagctctgcgggtggccgcctggtatcctttgaagtgccacagaacacctcagtcaagattcggcaagatgccactgcctcactgattttgctctggaaggtcacggccacaggattccaacagtgctccctcatagatggacgaagtgtgaccccccttcaggcttcagggggactggtcctcctggaggagatgctcgccttggggaataatcactttattggttttgtgaatgattctgtgactaagtctattgtggctttgcgcttaactctggtggtgaaggtcagcacctgtgtgccgggggagagtcacgcaaatgacttggagtgttcaggaaaaggaaaatgcaccacgaagccgtcagaggcaactttttcctgtacctgtgaggagcagtacgtgggtactttctgtgaagaatacgatgcttgccagaggaaaccttgccaaaacaacgcgagctgtattgatgcaaatgaaaagcaagatgggagcaatttcacctgtgtttgccttcctggttatactggagagctttgccagtccaagattgattactgcatcctagacccatgcagaaatggagcaacatgcatttccagtctcagtggattcacctgccagtgtccagaaggatacttcggatctgcttgtgaagaaaaggtggacccctgcgcctcgtctccgtgccagaacaacggcacctgctatgtggacggggtacactttacctgcaactgcagcccgggcttcacagggccgacctgtgcccagcttattgacttctgtgccctcagcccctgtgctcatggcacgtgccgcagcgtgggcaccagctacaaatgcctctgtgatccaggttaccatggcctctactgtgaggaggaatataatgagtgcctctccgctccatgcctgaatgcagccacctgcagggacctcgttaatggctatgagtgtgtgtgcctggcagaatacaaaggaacacactgtgaattgtacaaggatccctgcgctaacgtcagctgtctgaacggagccacctgtgacagcgacggcctgaatggcacgtgcatctgtgcacccgggtttacaggtgaagagtgcgacattgacataaatgaatgtgacagtaacccctgccaccatggtgggagctgcctggaccagcccaatggttataactgccactgcccgcatggttgggtgggagcaaactgtgagatccacctccaatggaagtccgggcacatggcggagagcctcaccaacatgccacggcactccctctacatcatcattggagccctctgcgtggccttcatccttatgctgatcatcctgatcgtggggatttgccgcatcagccgcattgaataccagggttcttccaggccagcctatgaggagttctacaactgccgcagcatcgacagcgagttcagcaatgccattgcatccatccggcatgccaggtttggaaagaaatcccggcctgcaatgtatgatgtgagccccatcgcctatgaagattacagtcctgatgacaaacccttggtcacactgattaaaactaaagatttgtaatctttttttggattatttttcaaaaagatgagatactacactcatttaaatatttttaagaaaataaaaagcttaagaaatttaaaatgctagctgctcaagagttttcagtagaatatttaagaactaattttctgcagcttttagtttggaaaaaatattttaaaaacaaaatttgtgaaacctatagacgatgttttaatgtaccttcagctctctaaactgtgtgcttctactagtgtgtgctcttttcactgtagacactatcacgagacccagattaatttctgtggttgttacagaataagtctaatcaaggagaagtttctgtttgacgtttgagtgccggctttctgagtagagttaggaaaaccacgtaacgtagcatatgatgtataatagagtatacccgttacttaaaaagaagtctgaaatgttcgttttgtggaaaagaaactagttaaatttactattcctaacccgaatgaaattagcctttgccttattctgtgcatgggtaagtaacttatttctgcactgttttgttgaactttgtggaaacattctttcgagtttgtttttgtcattttcgtaacagtcgtcgaactaggcctcaaaaacatacgtaacgaaaaggcctagcgaggcaaattctgattgatttgaatctatatttttctttaaaaagtcaagggttctatattgtgagtaaattaaatttacatttgagttgtttgttgctaagaggtagtaaatgtaagagagtactggttccttcagtagtgagtatttctcatagtgcagctttatttatctccaggatgtttttgtggctgtatttgattgatatgtgcttcttctgattcttgctaatttccaaccatattgaataaatgtgatcaagtcaagga

SEQ ID NO: 376 - protein, 737 aa, Artificial Sequence
  DNER
MQPRRAQAPGAQLLPALALLLLLLGAGPRGSSLANPVPAAPLSAPGPCAAQPCRNGGVCTSRPEPDPQHPAPAGEPGYSCTCPAGISGANCQLVADPCASNPCHHGNCSSSSSSSSDGYLCICNEGYEGPNCEQALPSLPATGWTESMAPRQLQPVPATQEPDKILPRSQATVTLPTWQPKTGQKVVEMKWDQVEVIPDIACGNASSNSSAGGRLVSFEVPQNTSVKIRQDATASLILLWKVTATGFQQCSLIDGRSVTPLQASGGLVLLEEMLALGNNHFIGFVNDSVTKSIVALRLTLVVKVSTCVPGESHANDLECSGKGKCTTKPSEATFSCTCEEQYVGTFCEEYDACQRKPCQNNASCIDANEKQDGSNFTCVCLPGYTGELCQSKIDYCILDPCRNGATCISSLSGFTCQCPEGYFGSACEEKVDPCASSPCQNNGTCYVDGVHFTCNCSPGFTGPTCAQLIDFCALSPCAHGTCRSVGTSYKCLCDPGYHGLYCEEEYNECLSAPCLNAATCRDLVNGYECVCLAEYKGTHCELYKDPCANVSCLNGATCDSDGLNGTCICAPGFTGEECDIDINECDSNPCHHGGSCLDQPNGYNCHCPHGWVGANCEIHLQWKSGHMAESLTNMPRHSLYIIIGALCVAFILMLIILIVGICRISRIEYQGSSRPAYEEFYNCRSIDSEFSNAIASIRHARFGKKSRPAMYDVSPIAYEDYSPDDKPLVTLIKTKDL

SEQ ID NO: 377 - DNA, 6325 bp, Artificial Sequence
  KAL1
ggtcggcgaggagggtccggccggagttgaaggattgaactttccggctcagtcgcggcgtctgcctggtcctcagcagtgcagccccggcgcggagcagggagcctcggcccgcgcccggcgccctcgccctcgccctcgacccgcagccatggtgcccggggtgcccggcgcggtcctgaccctctgcctctggctggcggcctccagcggctgcctggcggccggccccggcgcggctgctgcgcggcggctggacgagtcgctgtctgccgggagcgtccagcgcgctcgctgcgcctccaggtgcctgagcctgcagatcactcgcatctccgccttcttccagcacttccagaacaatggttccctggtttggtgccagaatcacaagcaatgttctaagtgcctggagccctgcaaggaatcaggggacctgaggaaacaccagtgccaaagcttttgtgagcctctcttccccaagaagagctacgaatgcttgaccagctgtgagttcctcaaatacatcctgttggtgaagcagggggactgtccggctcctgagaaagccagtggatttgcggccgcctgtgttgaaagctgcgaagttgacaatgagtgctctggggtgaagaaatgttgttcgaatgggtgtggacacacctgtcaagtacccaagactctgtacaaaggtgtccccctgaagcccagaaaagagttacgatttacagaactgcagtctggacagctggaggttaagtggtcctcgaaattcaatatttctattgagcctgtgatctatgtggtacaaagaagatggaattatggaatccatcctagcgaagatgacgccactcactggcagacagtggcccagaccacagacgagcgagttcaactgactgacataagacccagccgatggtaccagtttcgagtggctgctgtgaatgtgcatggaactcgaggcttcactgcccccagcaaacacttccgttcttccaaagatccatctgccccaccagcaccggctaacctccggctggccaactccaccgtcaacagtgatgggagtgtgaccgtcactatagtttgggatctccccgaggagccggacatccctgtgcatcattacaaggtcttttggagctggatggtcagcagtaagtctcttgtcccaacaaagaagaagcggagaaagactacggatgggtttcaaaattctgtgatcctggagaaactccagccagactgtgactatgttgtggaattgcaagccataacgtactggggacagacacggctgaagagtgcaaaggtgtcccttcacttcacatcgacacatgcaaccaacaacaaagaacagcttgtgaaaactagaaaaggtggaattcaaacacaactcccttttcaaagacgacgacccactcgcccgctggaagtcggagctcccttctatcaggatggccaactgcaagttaaagtctactggaagaagacagaagatcccactgtcaaccgatatcatgtgcggtggtttcctgaagcgtgtgcccacaacagaacaaccggatcagaggcatcatctggcatgacccacgaaaattacataattcttcaagatctgtcattttcctgcaagtataaggtgactgtccaaccaatacggccaaaaagtcactccaaggcagaagctgttttcttcactactccaccatgctctgctcttaaggggaagagccacaagcctgttggctgcctgggcgaagcaggtcatgttctttctaaggtgctagctaagcctgagaacctttctgcttcattcatcgtccaggatgtgaacatcaccggtcacttttcttggaagatggccaaggccaatctctatcagcccatgactgggtttcaagtgacttgggctgaggtcactacggaaagcagacagaacagcctacccaacagcattatttcacagtcccagatcctgccttccgatcattatgtcctaacagtgcccaatctgagaccatctactctttaccgactggaagtgcaagtgctgaccccaggaggggaggggccggccaccatcaagacgttccggacgccggagctcccaccctcttcagcacacagatctcatcttaagcatcgtcatccacatcattacaagccttctccagaaagatactaaactgttcaaaaagattttgtgaaattgcacagatgtgtaagcttgttgaacttcggccacgagacatgcacacttccagaggcagtgggaactgctcagaggcccggactctcctatgtgactttagtgcaggaagaacttctgtcaatcatggacgcatctggagacaagtgagaaacagtagattggtgaagacagacaccagttccctacaagcatggagaaaatgaagaataggcctgtttaatgctaaattttgttttcatgtatggtgtcgctcatttctattgaattacaacagaactcagttttccctgaatttggagcaccaaactccgccccaaaaaggagagtaacaaatacacaattcacacataacactaagcgtaaatctaatcaataaaatatatttttgactaaattattgattcgatatgaaaaatcaactaagattacacagctttgtttttttgaatctttcctaagatcatttttatcctaggtgatttttaaatgaaaatgtgtaatctaaaatataccagcgaatttaaatctaaaaatgctcctactttaagtaccttgtgctgctctttatgcaaaggtaaatcaaagttccctctataaattatgatttacaaaagacacccaagccagaggaactcaatgaaataagctgctaatcagattttaccttggagaaatgaaaattatttcttggggatgccttttaatatttgatcctattatgtgagagattttcctgatatgttatcttatttatattttcccttattttcctcaatgcagataatagcttttggtgcacttttgtttcaccatctgaaaattcacaaaacttcttgcttcaaatgaaaaaatcccaactattgagcatgtttaaatctttgcagagatttgccttttcttaatcaaagaaaggtctttgtgtgctagaatattattggtaatgttttaaaaattcctttgattgatagagaaggacagttatttgcatttaattcacccatatgctttcaaatctagtatatcttactttttggaaatgttttatgctacaaattagtgccttgtagcatgaacttaagtcaaaacgtgttatcaatatagagtgttgcagtgtatattgtaacaacctaaaacgcagagaagtttaatttaatactgttttttttcttgaaggaatactcacatacatggtttgaaatgtgcatagatatgcatgtctatataattataaatgcatgtgtatatatatgcaaatatatgtacatatacatgtatatacacacagacacatgcatatacatgaatataccttgagcatgaatccctggagaaatcgttttcgtagctcaccaatggtgagtaaagatacagctcttttaaaggtcataaggataatatattttccccatcaatgctgattctgagaaaagagcaatttatcaaaattaaacactgtaaaagaaaggtgtccatatgtctttacctacctaagtaaaacaggaagaaaatcagtaacattatccttaggttttgacaatggtacttgcttcttgttgttttattgtttcctgaattcatgcagatgcctggccattcctgggaagagtggataactcagaagtcactgtactccacagagcctcactgcagtgtctaaaggtagatgcaaattaaaatgcagggaaaataacttttctgatgttgatgcatgtctttgggaaacacatttataaacatggatacctgataatagatattgaaacccatttcctgtgtgttaaaatatttaaaaagtggatattccaggaatgttttgcagctttgtacaagtaacataaattggacacctcagaatgaaagttcatgttggttctgaatggttcactgcagctcctgtcacaagctgggatggatttatcacattgagttatgaaattacctggttctaagaatttttgagtggcaaaaatagaaaacaatcttcatttgaaaacatccctaagcttgaataaatggataccatagatagcttctcttttttattctggtgtcattaccagcatctgaatttcaagttcttaaaatttcaaaaattaaaatttttcattattagctatccatttatcttttacatgaacttgtcatgaacaaattcaaatgtttatgccagcaaatttttgtactgttgcatagttaaaaatgctgggagtctctgcatagatacaaaatattattaaattattacataaatttaattttataaaatttaatcatgcttcttttgtctgggtaatagacattggacagatatttttagttcagatggtgattctgaagcttacatctcccttaaaaaaatctaaagcagctcttatgggcttctaattttaatataaataaataatttaaattttattggtgttattggaagaaaaatgctattaatgggctaataaaaaacatgtgtttctcttatggattttaataagctccagtattattcaaatgatcaaaaatatagttataattttttgaattttaaaaatgtgattgctctaataaagaataaaatctatgctttttaacaaacatagttttggtgcctaattctgtaatatgttttattgaaattagattcatttctctaatgtgagaaaaatatatccagtaatagtattgactgtttaaaaaattgagctcatcaaaaatattgtcatcaaatacaggtggttaatctgacatacattgcagttacatgcattatttttatttacaacatttgctccttaatgatgaatttatctgtgttaccctgtttttctacctggaactccatagaatgatgtttgcaaaccaacatgtgctcttttcagtcattcactgttttaatatgacatggtagagaagataaggtttatggcaggtaattttttgtaatgtgtattaaacgaagttcaaagattagaaatacatctgtgtcctgaaaaccttagatacatagccgactgtatacagaggttcatctcaacctcaacactattgacttttggggctggatagttctctgttgtgggggtttgtcttgtgcactgtaggtttttagtagcatccacactttctcctcaccagatgccagttgcaccctcccccaagttgagacaaccaaaaatgtctccagatattgccagctaccccttgagggatggtacctctggttgagaaccattgctagagaatgatctttactgaatttgccctttataagaaacccagtgaatttctagagcaagtcccaaaaactaagggacagctaagaagttattatggttgacttcaaaggcctaaactgtgttttttatgtccactaaacaacttgattaaaagacggaattttgactcgtgtctgtatcatacaagtacaaatactaattttgccctatgtatccgtaaatgtcatttgtgattttgacttatttatttaatgccctttcttatgccgtgggttttcaagtttactcatttctatggttgcaaataactctaaaacttattatataaactttcatattataggcagaacacaatggctaaatatctgttgcatgtactttaaagtttattataaaatataaacagatatataaagatgttgactcttacctgtgattttgcatggtcagactcggtgtcaggtacggagaggattctcatgactgtcttacctctactgaatattctagtgagttatatgatttacggagtgattaacagaggtctatataaagttacttttcccctttacttaattatattgtagtgtgcagataacaaaactgctaccttctcatccaagtggtctgtagaattcatgtcccttacagtggtcatttaaagtcaatatttatttatgtatgtaataaaaaaagttggatttttgtgtatgtctgtcacattatttagagagaagtaatcttgtaaaaatgttttgtaaaaaacaaaaaagtattgtaaatagtcttgatattctgtgactcattattttcatgttagagtttgtacatactggttcaataataaagtatccttaaaccagaaaaaaaaaaa

SEQ ID NO: 378 - protein, 680 aa, Artificial Sequence
  KAL1
MVPGVPGAVLTLCLWLAASSGCLAAGPGAAAARRLDESLSAGSVQRARCASRCLSLQITRISAFFQHFQNNGSLVWCQNHKQCSKCLEPCKESGDLRKHQCQSFCEPLFPKKSYECLTSCEFLKYILLVKQGDCPAPEKASGFAAACVESCEVDNECSGVKKCCSNGCGHTCQVPKTLYKGVPLKPRKELRFTELQSGQLEVKWSSKFNISIEPVIYVVQRRWNYGIHPSEDDATHWQTVAQTTDERVQLTDIRPSRWYQFRVAAVNVHGTRGFTAPSKHFRSSKDPSAPPAPANLRLANSTVNSDGSVTVTIVWDLPEEPDIPVHHYKVFWSWMVSSKSLVPTKKKRRKTTDGFQNSVILEKLQPDCDYVVELQAITYWGQTRLKSAKVSLHFTSTHATNNKEQLVKTRKGGIQTQLPFQRRRPTRPLEVGAPFYQDGQLQVKVYWKKTEDPTVNRYHVRWFPEACAHNRTTGSEASSGMTHENYIILQDLSFSCKYKVTVQPIRPKSHSKAEAVFFTTPPCSALKGKSHKPVGCLGEAGHVLSKVLAKPENLSASFIVQDVNITGHFSWKMAKANLYQPMTGFQVTWAEVTTESRQNSLPNSIISQSQILPSDHYVLTVPNLRPSTLYRLEVQVLTPGGEGPATIKTFRTPELPPSSAHRSHLKHRHPHHYKPSPERY

SEQ ID NO: 379 - DNA, 5429 bp, Artificial Sequence
  CD45
agaacaacttttttgacttcctgcaaagaggacccttacagtatttttggagaagttagtaaaaccgaatctgacatcatcacctagcagttcatgcagctagcaagtggtttgttcttagggtaacagaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaa

SEQ ID NO: 380 - protein, 1306 aa, Artificial Sequence
  CD45
MTMYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 381 - DNA, 1860 bp, Artificial Sequence
  AMY1C
ggcttggtgagtctgtgtggtcagcagtctctgatccgtgcagggtattaatgtgtcagggctgagtgttctgagatttatctagaggctgggaagggctcctgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcatgccttctgacagagcgcttgtctttgtggataaccatgacaatcaacgaggacatggcgctggaggagcctctatacttaccttctgggatgctaggctgtacaaaatggcagttggatttatgcttgctcatccttatggatttacacgagtaatgtcaagctaccgttggccaagatattttgaaaatggaaaagatgttaatgattgggttgggccaccaaatgataatggagtaactaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagc

SEQ ID NO: 382 - protein, 511 aa, Artificial Sequence
  AMY1C
MKLFWLLFTIGFCWAQYSSNTQQGRTSIVHLFEWRWVDIALECERYLAPKGFGGVQVSPPNENVAIHNPFRPWWERYQPVSYKLCTRSGNEDEFRNMVTRCNNVGVRIYVDAVINHMCGNAVSAGTSSTCGSYFNPGSRDFPAVPYSGWDFNDGKCKTGSGDIENYNDATQVRDCRLSGLLDLALGKDYVRSKIAEYMNHLIDIGVAGFRIDASKHMWPGDIKAILDKLHNLNSNWFPEGSKPFIYQEVIDLGGEPIKSSDYFGNGRVTEFKYGAKLGTVIRKWNGEKMSYLKNWGEGWGFMPSDRALVFVDNHDNQRGHGAGGASILTFWDARLYKMAVGFMLAHPYGFTRVMSSYRWPRYFENGKDVNDWVGPPNDNGVTKEVTINPDTTCGNDWVCEHRWRQIRNMVNFRNVVDGQPFTNWYDNGSNQVAFGRGNRGFIVFNNDDWTFSLTLQTGLPAGTYCDVISGDKINGNCTGIKIYVSDDGKAHFSISNSAEDPFIAIHAESKL

SEQ ID NO: 383 - DNA, 1862 bp, Artificial Sequence
  AMY1A
tggcttggtgagtctgtgtggtcagcagtctctgatccgtgcagggtattaatgtgtcagggctgagtgttctgagatttatctagaggctgggaagggctcctgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcatgccttctgacagagcgcttgtctttgtggataaccatgacaatcaacgaggacatggcgctggaggagcctctatacttaccttctgggatgctaggctgtacaaaatggcagttggatttatgcttgctcatccttatggatttacacgagtaatgtcaagctaccgttggccaagatattttgaaaatggaaaagatgttaatgattgggttgggccaccaaatgataatggagtaactaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagca

SEQ ID NO: 384 - protein, 510 aa, Artificial Sequence
  AMY1A
MKLFWLLFTIGFCWAQYSSNTQQGRTSIVHLFEWRWVDIALECERYLAPKGFGGVQVSPPNENVAIHNPFRPWWERYQPVSYKLCTRSGNEDEFRNMVTRCNNVGVRIYVDAVINHMCGNAVSAGTSSTCGSYFNPGSRDFPAVPYSGWDFNDGKCKTGSGDIENYNDATQVRDCRLSGLLDLALGKDYVRSKIAEYMNHLIDIGVAGFRIDASKHMWPGDIKAILDKLHNLNSNWFPEGSKPFIYQEVIDLGGEPIKSSDYFGNGRVTEFKYGAKLGTVIRKWNGEKMSYLKNWGEGWGFMPSDRALVFVDNHDNQRGHGAGGASILTFWDARLYKMAVGFMLAHPYGFTRVMSSYRWPRYFENGKDVNDWVGPPNDNGVTKEVTINPDTTCGNDWVCEHRWRQIRNMVNFRNVVDGQPFTNWYDNGSNQVAFGRGNRGFIVFNNDDWTFSLTLQTGLPAGTYCDVISGDKINGNCTGIKIYVSDDGKAHFSISNSAEDPFIAIHAESK

SEQ ID NO: 385 - DNA, 1294 bp, Artificial Sequence
  GCG
gcatagaatgcagatgagcaaagtgagtgggagagggaagtcatttgtaacaaaaactcattatttacagatgagaaatttatattgtcagcgtaatatctgtgaggctaaacagagctggagagtatataaaagcagtgcgccttggtgcagaagtacagagcttaggacacagagcacatcaaaagttcccaaagagggcttgctctctcttcacctgctctgttctacagcacactaccagaagacagcagaaatgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcttcacaacatcacctgctagccacgtgggatgtttgaaatgttaagtcctgtaaatttaagaggtgtattctgaggccacattgctttgcatgccaataaataaattttcttttagtgttgtgtagccaaaaattacaaatggaataaagttttatcaaaatattgctaaaatatcagctttaaaatatgaaagtgctagattctgttattttcttcttattttggatgaagtaccccaacctgtttacatttagcgataaaattatttttctatgatataatttgtaaatgtaaattattccgatctgacatatctgcattataataataggagaatagaagaactggtagccacagtggtgaaattggaaagagaactttcttcctgaaacctttgtcttaaaaatactcagctttcaatgtatcaaagatacaattaaataaaattttcaagcttctttaccattgtct

SEQ ID NO: 386 - protein, 180 aa, Artificial Sequence
  GCG
MKSIYFVAGLFVMLVQGSWQRSLQDTEEKSRSFSASQADPLSDPDQMNEDKRHSQGTFTSDYSKYLDSRRAQDFVQWLMNTKRNRNNIAKRHDEFERHAEGTFTSDVSSYLEGQAAKEFIAWLVKGRGRRDFPEEVAIVEELGRRHADGSFSDEMNTILDNLAARDFINWLIQTKITDRK

SEQ ID NO: 387 - DNA, 1269 bp, Artificial Sequence
  CEBPD
aggtgacagcctcgcttggacgcagagcccggcccgacgccgccatgagcgccgcgctcttcagcctggacggcccggcgcgcggcgcgccctggcctgcggagcctgcgcccttctacgaaccgggccgggcgggcaagccgggccgcggggccgagccaggggccctaggcgagccaggcgccgccgcccccgccatgtacgacgacgagagcgccatcgacttcagcgcctacatcgactccatggccgccgtgcccaccctggagctgtgccacgacgagctcttcgccgacctcttcaacagcaatcacaaggcgggcggcgcggggcccctggagcttcttcccggcggccccgcgcgccccttgggcccgggccctgccgctccccgcctgctcaagcgcgagcccgactggggcgacggcgacgcgcccggctcgctgttgcccgcgcaggtggccgcgtgcgcacagaccgtggtgagcttggcggccgcagggcagcccaccccgcccacgtcgccggagccgccgcgcagcagccccaggcagacccccgcgcccggccccgcccgggagaagagcgccggcaagaggggcccggaccgcggcagccccgagtaccggcagcggcgcgagcgcaacaacatcgccgtgcgcaagagccgcgacaaggccaagcggcgcaaccaggagatgcagcagaagttggtggagctgtcggctgagaacgagaagctgcaccagcgcgtggagcagctcacgcgggacctggccggcctccggcagttcttcaagcagctgcccagcccgcccttcctgccggccgccgggacagcagactgccggtaacgcgcggccggggcgggagagactcagcaacgacccatacctcagacccgacggcccggagcggagcgcgccctgccctggcgcagccagagccgccgggtgcccgctgcagtttcttgggacataggagcgcaaagaagctacagcctggacttaccaccactaaactgcgagagaagctaaacgtgtttattttcccttaaattatttttgtaatggtagctttttctacatcttactcctgttgatgcagctaaggtacatttgtaaaaagaaaaaaaaccagacttttcagacaaaccctttgtattgtagataagaggaaaagactgagcatgctcacttttttatattaatttttacagtatttgtaagaataaagcagcatttgaaatcgaaaaaaaaaaaaaaaaaa

SEQ ID NO: 388 - protein, 269 aa, Artificial Sequence
  CEBPD
MSAALFSLDGPARGAPWPAEPAPFYEPGRAGKPGRGAEPGALGEPGAAAPAMYDDESAIDFSAYIDSMAAVPTLELCHDELFADLFNSNHKAGGAGPLELLPGGPARPLGPGPAAPRLLKREPDWGDGDAPGSLLPAQVAACAQTVVSLAAAGQPTPPTSPEPPRSSPRQTPAPGPAREKSAGKRGPDRGSPEYRQRRERNNIAVRKSRDKAKRRNQEMQQKLVELSAENEKLHQRVEQLTRDLAGLRQFFKQLPSPPFLPAAGTADCR

SEQ ID NO: 389 - DNA, 4285 bp, Artificial Sequence
  STEAP3
gaggaggagcctcgggccgagccaccgccttcgccgcggaccttcagctgccgcggtcgctccgagcggcgggccgcagagatgacatttattcattttatgcatcctgggttctactggtcgtcccacctcagttcctgtagcaaagagacttgagtctgagccactaattatcacccgtgaggtttcctccccgagcaggaagcagcaggccagagctgcgctctctcagtgcactctccaaccaagcatcagtcaccactcccggtccagcccctgtggccaagagctggcgtgcaggctgcgggaggcagctggctgtgcaagaccctggcagggccctcgcctcctgagaaaccgagagtcagaaccaaagccaggctgtcctggttggagactgagccagaaagggtggctcacctcacggtgaggctgtcgagtgacctgagagcctcagaccctcacgtcagccggatgtcgcaccagcctgctgttgccaccaaaatgccagaagagatggacaagccactgatcagcctccacctggtggacagcgatagtagccttgccaaggtccccgatgaggcccccaaagtgggcatcctgggtagcggggactttgcccgctccctggccacacgcctggtgggctctggcttcaaagtggtggtggggagccgcaaccccaaacgcacagccaggctgtttccctcagcggcccaagtgactttccaagaggaggcagtgagctccccggaggtcatctttgtggctgtgttccgggagcactactcttcactgtgcagtctcagtgaccagctggcgggcaagatcctggtggatgtgagcaaccctacagagcaagagcaccttcagcatcgtgagtccaatgctgagtacctggcctccctcttccccacttgcacagtggtcaaggccttcaatgtcatctctgcctggaccctgcaggctggcccaagggatggtaacaggcaggtgcccatctgcggtgaccagccagaagccaagcgtgctgtctcggagatggcgctcgccatgggcttcatgcccgtggacatgggatccctggcgtcagcctgggaggtggaggccatgcccctgcgcctcctcccggcctggaaggtgcccaccctgctggccctggggctcttcgtctgcttctatgcctacaacttcgtccgggacgttctgcagccctatgtgcaggaaagccagaacaagttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtcctcactgggctttgtggccctcgtgctgagcacactgcacacgctcacctacggctggacccgcgccttcgaggagagccgctacaagttctacctgcctcccaccttcacgctcacgctgctggtgccctgcgtcgtcatcctggccaaagccctgtttctcctgccctgcatcagccgcagactcgccaggatccggagaggctgggagagggagagcaccatcaagttcacgctgcccacagaccacgccctggccgagaagacgagccacgtatgaggtgcctgccctgggctctggaccccgggcacacgagggacggtgccctgagcccgttaggttttcttttcttggtggtgcaaagtggtataactgtgtgcaaataggaggtttgaggtccaaattcctgggactcaaatgtatgcagtactattcagaatgatatacacacatatgtgtatatgtatttacatatattccacatatataacaggatttgcaattatacatagctagctaaaaagttgggtctctgagatttcaacttgtagatttaaaaacaagtgccgtacgttaagagaagagcagatcatgctattgtgacatttgcagagatatacacacactttttgtacagaagaggcttgtgctgtggtgggttcgatttatccctgcccaccccacccccacaacttcccttttgctacttccccaaggctcttgcagagctagggctctgaaggggagggaaggcaacggctctgcccagagccatccctggagcatgtgagcagcggctggtctcttccctccacctggggcagcagcaggaggcctggggaggaggaaaatcaggcagtcggcctggagtctgtgcctggtcctttgcccggtggtgggaggatggagggattgggctgaagctgctccacctcatccttgctgagtgggggagacattttccctgaaagtcagaagtcaccatagagcctgcaaatggatcctcctgtgagagtgacgtcacctcctttccagagccattagtgagcctggcttgggaacaagtgtaatttccttccctcctttaacctggcgatgagcgtcctttaaaccactgtgccttctcaccctttccatcttcagtttgaatgactcccaggaaggcctagagcagaccctttagaaatcagcccaagggggagagcaagagaaaacactctagggagtaaagctccccgggcgtcagagttgagccctgcctgggctgaaggactgtcttcacgaagtcagtcctgaggaaaaatattggggactccaaatgtcctctggcagaggacccagaaaaccacactggctccaacttcctcctcatggggcattacacttcaaaacagtggggagcaacttttccaccaaagctacaaacctaaaatgctgctgccccaaagcacaagagggaagagcaccgccggggccacaggacgtctgtcctccagtcacaggccatccttgctgctccctactgactctagcttacttcccctgtgaagaaacaggtgttctcggctgagcccccaaccctctgcagaaccaggttgatctgccacagaaaaagcatctttgaagacaaagagggtgaggtcttcatgagtctcctgggcccaaagccatcttctgatggaaggaagagagtagggccagtgaaggctgcccagagagaatgtcacagatgaggctgcccctgccccccccccgccagggaggtttcatgagctcatgtctatgcagcacataagggttcttcagtgaaaagcaggagaagagcccactgcaaggatagctcattaggcacatgaccgatgcagggaaggccatgccggggaagctcttcctgcaggtattttccatctgctgtgccaaggctgagcggcagaaacttgtctcataaattggcactgatggagcatcagctgtggcccacagagagccttgctgagaagggggcaggtaaagcagagattttagcattgccttggcataacaagggcccatcgattccctactaatgagaggcagggagagcatgggcaatggagacccaccaatgatccccaaccccggtgggtactggctgcctgccctgggccagggaatggctccttataccaaagatgctggcacatagcagaacccagtgcacgtcctccccttcccacccacctctggctgaaggtgctcaagagggaagcaattataaggtgggtggcaggagggaacaggtgccacctgctggacaatcacacgaaaggcaggcgggctgtgtactgggccctgactgtgcgtccactgctgtcttccctacctcaccaggctactggcagcagcatcccgagagcacatcatctccacagcctggtaaattccatgtgcctctgggtacaaaagtgcctcaacgacatgctctggaaatcccaaatgccacagtctgaggttgatatctaaaatctatgccttcaaaagagtctctgttttttttttttaacctggtagacagtataaaagcagtgcaaataaacacctaaccttctgcaaa

SEQ ID NO: 390 - protein, 498 aa, Artificial Sequence
  STEAP3
MSHQPAVATKMPEEMDKPLISLHLVDSDSSLAKVPDEAPKVGILGSGDFARSLATRLVGSGFKVVVGSRNPKRTARLFPSAAQVTFQEEAVSSPEVIFVAVFREHYSSLCSLSDQLAGKILVDVSNPTEQEHLQHRESNAEYLASLFPTCTVVKAFNVISAWTLQAGPRDGNRQVPICGDQPEAKRAVSEMALAMGFMPVDMGSLASAWEVEAMPLRLLPAWKVPTLLALGLFVCFYAYNFVRDVLQPYVQESQNKFFKLPVSVVNTTLPCVAYVLLSLVYLPGVLAAALQLRRGTKYQRFPDWLDHWLQHRKQIGLLSFFCAALHALYSFCLPLRRAHRYDLVNLAVKQVLANKSHLWVEEEVWRMEIYLSLGVLALGTLSLLAVTSLPSIANSLNWREFSFVQSSLGFVALVLSTLHTLTYGWTRAFEESRYKFYLPPTFTLTLLVPCVVILAKALFLLPCISRRLARIRRGWERESTIKFTLPTDHALAEKTSHV

SEQ ID NO: 391 - DNA, 2648 bp, Artificial Sequence
  AMT1B
atgagcgaagcttgtctcctcgctgcaaagtcggctttggtcggcgtcgccaatggcgatagcctcgcgtccgcaatttgcgcggcgatggaggctgccgcaccagtggctcgccacctgcaagagacaacggtggatctaactacgctccaagagacggtcgacactattgggctgaacttgcaaggcacaatggacggcctgaacacgctgctgctgctctacggaggcgcgctggtgttcctgatgcacggaggcttcgctatgctcgaggccggtgccatccgctccaagaacgcgatgaacatcctgctgcagaccgtcctcgacgcctcttgcagcgcgctcatgtggtacttcgtcgggttcgccttcgccttcggcattggcgacaagcccaacaagtttatcggcaacgccatgtttgcgctggtggacattgatacgcacaacaccggctcgggcaccggcaagtggatcgactggttcttccagtgggccttcgccgcaaccgccgtcaccattcccgccggcgctgtggctgagcgtttcaacttcaacgcctacctgggctattccatgttcatcggtggctgggtctaccccatcattgcccactgggtgtggtgcattgagggctggctgggctatggcgtgatcaagcccttcatcaacgccggcatgattgacttcgccggatccggcgtcatccacatgactggcggcctggccggcctcatcggcgccatcatggtgggcccccgcctgggccgcttcgacgccgacggcaagcccgtcgacatgcccggccactccgccatcctggtggtgctgggaaccgtactgctgtggttcggctggtacggcttcaaccccgcctccgtgctgctcatcaactccagcacctacgccatcgtgtgcggccgcgcggccgtgtgcaccacgctggccggcgccgcgggcggcgtgagctgcctcatcttcggctttgcgcgccaccgcggctgggacctggtcggcctctgcaacggcatcctgtgcggcttcgtcgcagtcaccgcctgcccccacgtgatctacccctgggccgcaatcatctgcggcctggtcgcgggcctgtggtttgagttcctgtgctggctgttgctcaagctcaagatcgacgacccgttgtcagctgggccgatgcacttcggctgcggcatgtggggcgtcttcttcaccggcctcttcgcgcgccagcaatacatccaggagtactacgtgcacggcccttccgcggccggcgagctgtccaagccctacccctggggcgccttctacaagggctacaatgccgacggcgagctggtcatgtccgatggcaagctgctcgcgtcgcagatcgtgggcatcctggttatcatcggctgggtgattggcatgatggttccgttcttcggcattttcaagttctttggcgcgcttcgcattccgcccgaggaggaggagatgggcctggaccgctccaagcacggcggctcggcctacaatggcaccggtgccaacacgctcggcggcctgtcgcccggcaacgacgtgatgcgaaacaactcgcctttgggcaaggttctgcctgtgaccgcgtaaggaccggcggcgttatgcggcacgacggcgtcaggggatcaggagggaacgcagaaccggagctgtggctgcggccatggcagcggcggcggctggtgaccgacgttcttgtgaggatggtaaagggcgagcattcaaatgcgtgagcgtgaagaactgcagtgtgtggattggggagggggggccagattccactagcacgttgtgtgctgctggcagcagcacgatgattgacgattggaaaacgcttgctcgtgagcggctcgtgtgacgtgactaggggcgcattttttgacagagcgatccgaatgtatgcctatgatcagtaagggcatacgttgctgctgcttgggcgcgggggcctgctgcgccagttgcattgctgcctgcgtgtcaggcccgttgggcgcccattcgagtttggcgttccgcattcatatcacacctacttaagcgccacacattcacgcatcccagccccttgcccggatctgaaccatactataatgcatcatgtttgacaagtgtctgtgtgtgactgtcgtgacttaaaccatgagcgcgcgctgccgggtgctgattgcgagaaggctggacggcttcgcaggtgactggaccgcaggacagcgtgcttttactttctggtacggtacgaattgcttgacacctccttgcacaatgaattgtcgtgtgtgcgcgcgtaacttcgtagatttgaaagtagtcttgttgtgcgctcgcgtgtgatttgcgcccccctgagtgatttcctgtgaacagttcggaccttgaagttacttgtatgggcatatgggtaaacagcgatcttcagaggaccaacttcagtcaggggacggaaggcatggtgtgcatcaggtgcgtgtgtgcgtgcgtgcatgtggtggacggagattgggccgaggggaaagaaagcccccgcgccatgactgtgacggcggcactgcaaagtgggcgcacgtccagagccaaacaacggctgtaacgatattccgaatgcc

SEQ ID NO: 392 - protein, 542 aa, Artificial Sequence
  AMT1B
MSEACLLAAKSALVGVANGDSLASAICAAMEAAAPVARHLQETTVDLTTLQETVDTIGLNLQGTMDGLNTLLLLYGGALVFLMHGGFAMLEAGAIRSKNAMNILLQTVLDASCSALMWYFVGFAFAFGIGDKPNKFIGNAMFALVDIDTHNTGSGTGKWIDWFFQWAFAATAVTIPAGAVAERFNFNAYLGYSMFIGGWVYPIIAHWVWCIEGWLGYGVIKPFINAGMIDFAGSGVIHMTGGLAGLIGAIMVGPRLGRFDADGKPVDMPGHSAILVVLGTVLLWFGWYGFNPASVLLINSSTYAIVCGRAAVCTTLAGAAGGVSCLIFGFARHRGWDLVGLCNGILCGFVAVTACPHVIYPWAAIICGLVAGLWFEFLCWLLLKLKIDDPLSAGPMHFGCGMWGVFFTGLFARQQYIQEYYVHGPSAAGELSKPYPWGAFYKGYNADGELVMSDGKLLASQIVGILVIIGWVIGMMVPFFGIFKFFGALRIPPEEEEMGLDRSKHGGSAYNGTGANTLGGLSPGNDVMRNNSPLGKVLPVTA

We claim:

1. A method of transdifferentiating mammalian preadipocytes, the method comprising:
   (a) culturing mammalian preadipocytes;
   (b) infecting the mammalian preadipocytes with a viral vector encoding Oct4 such that the mammalian preadipocytes overexpress Oct4;
   (c) culturing the infected cells until about 100% confluent;
   (d) subculturing the cells of step (c), wherein subculturing comprises seeding at least a portion of the cells onto a mouse embryonic fibroblast (MEF) feeder cell layer;
   (e) expanding the cells seeded onto the feeder layer of step (d) for a period of time sufficient to produce a population of cells which produce glucagon and which express a pancreatic alpha cell marker gene selected from the group consisting of CGC, CNTN1, PCSK1, PDK4, RGS4, IRX2, LPPR4, LOXL2, KCTD12, KL, and any combination thereof.

2. The method of claim 1, further comprising overexpressing exogenous Klf4 in at least one of the mammalian preadipocytes.

3. The method of claim 2, wherein the exogenous Klf4 is simultaneously overexpressed with exogenous Oct4 in the same mammalian preadipocyte.

4. The method of claim 2, wherein overexpression of exogenous Klf4 occurs via transfection or transduction of the at least one mammalian preadipocyte with an exogenous Klf4.

5. The method of claim 1, further comprising overexpressing exogenous Sox2 in at least one of the mammalian preadipocytes.

6. The method of claim 5, wherein overexpression of exogenous Sox2 occurs via transfection or transduction of the at least one mammalian preadipocyte with an exogenous Sox2.

7. The method of claim 1, further comprising overexpressing exogenous cMyc at least one of the mammalian preadipocytes.

8. The method of claim 7, wherein exogenous cMyc is simultaneously overexpressed with exogenous Oct4 in the same mammalian preadipocyte.

9. The method of claim 1, wherein the mammalian preadipocytes have been passaged 3 times or less prior to overexpression of exogenous Oct4.

10. The method of claim 1, wherein the cells seeded onto the feeder layer are expanded on the feeder layer for about 3, 4, 5, 6, 7, 8, 9, or about 10 days.

11. The method of claim 1, wherein culturing the population of cells is performed without passaging for about 1,2,3, 4, or 5 days prior to performing subculturing of cells.

12. The method of claim 1, further comprising the step of contacting the population of cells of producing glucagon with a compound.

13. The method of claim 12, further comprising the step of evaluating a characteristic of the cells producing glucagon, wherein the characteristic is selected from the group consisting of cell growth, cell development, cell differentiation, glucagon production, apoptosis, cytotoxicity, and any combination thereof.

14. The method of claim 1, further comprising overexpressing exogenous Kif 4, exogenous cMyc, and exogenous Sox2 in the at least one mammalian preadipocyte.

15. The method of claim 1, wherein expanding the cells is performed using a serum free media.

16. The method of claim 1, wherein the cells producing glucagon express NeuroD.

* * * * *